United States Patent
Fong et al.

(10) Patent No.: US 9,945,864 B2
(45) Date of Patent: Apr. 17, 2018

(54) DISEASE-ASSOCIATED ANTIGENS AND METHODS OF USE THEREOF

(71) Applicant: The Regents of the University of California, Oakland, CA (US)

(72) Inventors: Lawrence H. Fong, Palo Alto, CA (US); Serena Kwek MacPhee, Oakland, CA (US)

(73) Assignee: The Regents of the University of California, Oakland, CA (US)

(*) Notice: Subject to any disclaimer, the term of this patent is extended or adjusted under 35 U.S.C. 154(b) by 0 days.

(21) Appl. No.: 14/977,359

(22) Filed: Dec. 21, 2015

(65) Prior Publication Data

US 2016/0109454 A1    Apr. 21, 2016

Related U.S. Application Data

(62) Division of application No. 13/124,922, filed as application No. PCT/US2009/062320 on Oct. 28, 2009, now abandoned.

(60) Provisional application No. 61/109,428, filed on Oct. 29, 2008.

(51) Int. Cl.

| | |
|---|---|
| *A61K 38/00* | (2006.01) |
| *C07K 14/00* | (2006.01) |
| *C07K 14/47* | (2006.01) |
| *G01N 33/574* | (2006.01) |
| *A61K 39/395* | (2006.01) |
| *C07K 14/705* | (2006.01) |
| *A61K 39/00* | (2006.01) |
| *C07K 16/30* | (2006.01) |
| *G01N 33/564* | (2006.01) |

(52) U.S. Cl.
CPC .... *G01N 33/57434* (2013.01); *A61K 39/0011* (2013.01); *A61K 39/39558* (2013.01); *C07K 14/4748* (2013.01); *C07K 14/705* (2013.01); *C07K 16/30* (2013.01); *G01N 33/564* (2013.01); *C07K 2317/24* (2013.01); *G01N 2800/042* (2013.01); *G01N 2800/104* (2013.01); *G01N 2800/50* (2013.01); *G01N 2800/52* (2013.01)

(58) Field of Classification Search
CPC ......... A61K 38/00; C07K 14/00; C07K 14/47

USPC ............................ 424/185.1, 184.1; 530/350
See application file for complete search history.

(56) References Cited

U.S. PATENT DOCUMENTS

| | | |
|---|---|---|
| 2002/0090372 A1 | 7/2002 | Xu et al. |
| 2003/0083481 A1 | 5/2003 | Birse et al. |
| 2003/0096327 A1 | 5/2003 | Magnani |
| 2004/0023242 A1 | 2/2004 | Yue et al. |
| 2005/0125852 A1 | 6/2005 | Caenepeel et al. |
| 2006/0194730 A1 | 8/2006 | Eisenbach et al. |
| 2007/0020687 A1 | 1/2007 | Cheng et al. |
| 2007/0083334 A1 | 4/2007 | Mintz et al. |
| 2007/0128633 A1 | 6/2007 | Zozulya et al. |
| 2008/0171061 A1 | 7/2008 | Nixon et al. |
| 2010/0247552 A1 | 9/2010 | Tonegawa et al. |
| 2010/0322896 A1 | 12/2010 | Hill et al. |

FOREIGN PATENT DOCUMENTS

| | | | |
|---|---|---|---|
| WO | WO 2000/033870 | | 6/2000 |
| WO | WO 200153793 | * | 7/2001 |

OTHER PUBLICATIONS

NCBI-PAK6 (Jan. 4, 2017, pp. 1-3).*
Kaur et al. (The Prostate, Jul. 18, 2008, 68: 1510-1516).*
V. Lampasona et al., "Antibodies to tissue transglutaminase C in Type I diabetes", Diabetologia 42: 1195-1198 (1999).
Eswaran, et al.; "Crystal Structures of the p21-Activated Kinases PAK4, PAK5, and PAK6 Reveal Catalytic Domain Plasticity of Active Group II PAKs"; Structure; vol. 15, pp. 201-2013 (Feb. 2007).
Kwek, et al.; "Diversity of Antigen-Specific Responses Induced In Vivo with CTLA-4 Blockade in Prostate Cancer Patients"; The Journal of Immunology; vol. 189, pp. 3759-3766 (2012).
Yang, et al.; "Androgen Receptor Specifically Interacts with a Novel p21-activated Kinase, PAK6"; The Journal of Biological Chemistry; vol. 276, No. 18, pp. 15345-15353 (2001).

* cited by examiner

*Primary Examiner* — Yan Xiao
(74) *Attorney, Agent, or Firm* — Bozicevic Field & Francis, LLP; Paula A. Borden

(57) ABSTRACT

The present disclosure provides synthetic antibodies specific for a disease-associated antigen, and methods of using the antibodies in disease therapy. The present disclosure further provides diagnostic assays involving detecting the presence and/or level in biological sample of an antibody specific for a disease-associated antigen.

13 Claims, 4 Drawing Sheets pr125 m3 400x
low grade tumor
FIG. 4a
pr328-T 400x
high grade tumor
FIG. 4c
Patient 20 400x
tumor biopsy
FIG. 4e
FIG. 4b
FIG. 4d
FIG. 4f
zs06-6327 200x
tumor region
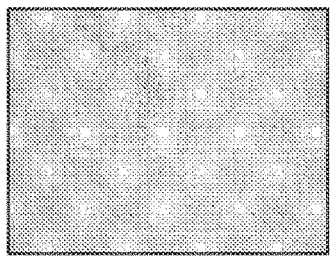
FIG. 4g
zs06-6327 200x
benign region
FIG. 4h
Patient 24 200x
tumor biopsy
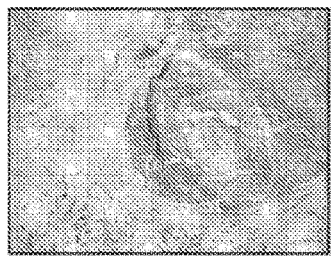
FIG. 4i
p801-4 200x
tumor region
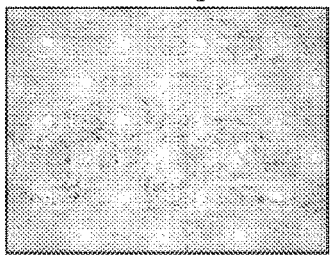
FIG. 4j
p801-4 200x
benign region
FIG. 4k
zs06-4762 200x
tumor and benign region
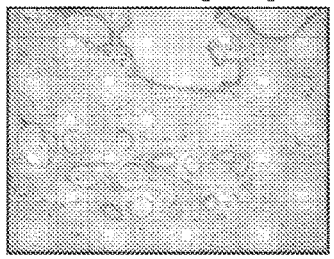
FIG. 4l

DISEASE-ASSOCIATED ANTIGENS AND METHODS OF USE THEREOF

CROSS-REFERENCE

This application is a divisional of U.S. patent application Ser. No. 13/124,922, filed Jun. 29, 2011, which is a national stage filing under 35 U.S.C. §371 of PCT/US09/62320, filed Oct. 28, 2009, which claims the benefit of U.S. Provisional Patent Application No. 61/109,428, filed Oct. 29, 2008, each of which applications is incorporated herein by reference in its entirety.

STATEMENT REGARDING FEDERALLY SPONSORED RESEARCH

The U.S. government has certain rights in this invention, pursuant to grant nos. R01 CA 102303 and U19 AI056388 awarded by the National Institutes of Health.

BACKGROUND

Worldwide, prostate cancer is the fourth most prevalent cancer in men. In North America and Northern Europe, it is by far the most common cancer in males and is the second leading cause of cancer death in men. In the United States alone, well over 30,000 men die annually of this disease—second only to lung cancer. Despite the magnitude of these figures, there is still no effective treatment for metastatic prostate cancer. Surgical prostatectomy, radiation therapy, hormone ablation therapy, surgical castration and chemotherapy continue to be the main treatment modalities. Unfortunately, these treatments are ineffective for many and are often associated with undesirable consequences.

Systemic lupus erythematosus (SLE) is an autoimmune disease that can affect many different tissues. The diagnosis and assessment of this disease relics primarily on clinical findings including the scoring of manifestations according to the SLE disease activity index (SLEDAI). Aside from the presence of an array of clinical symptoms, the only widely used biological assay to diagnose lupus involves detecting auto-antibodies to nuclear components of cells such as to dsDNA and ribonucleoproteins, which is not completely reliable. Type 1 insulin dependent diabetes mellitus is a chronic metabolic syndrome with an autoimmune component. Current diagnostic methods are based primarily on the detection of hyperglycemia and related conditions which develop as a result of significant damage to beta islet cells. There is a need in the art for new approaches to the diagnosis and assessment of autoimmune diseases such as SLE and type 1 insulin dependent diabetes mellitus.

SUMMARY OF THE INVENTION

The present disclosure provides synthetic antibodies specific for a disease-associated antigen, and methods of using the antibodies in disease therapy. The present disclosure further provides diagnostic assays involving detecting the presence and/or level in biological sample of an antibody specific for a disease-associated antigen.

BRIEF DESCRIPTION OF THE DRAWINGS

FIGS. 4A-L depict immunohistochemical analysis of patients' biopsies and prostate tumors.

DEFINITIONS

Figure 1:
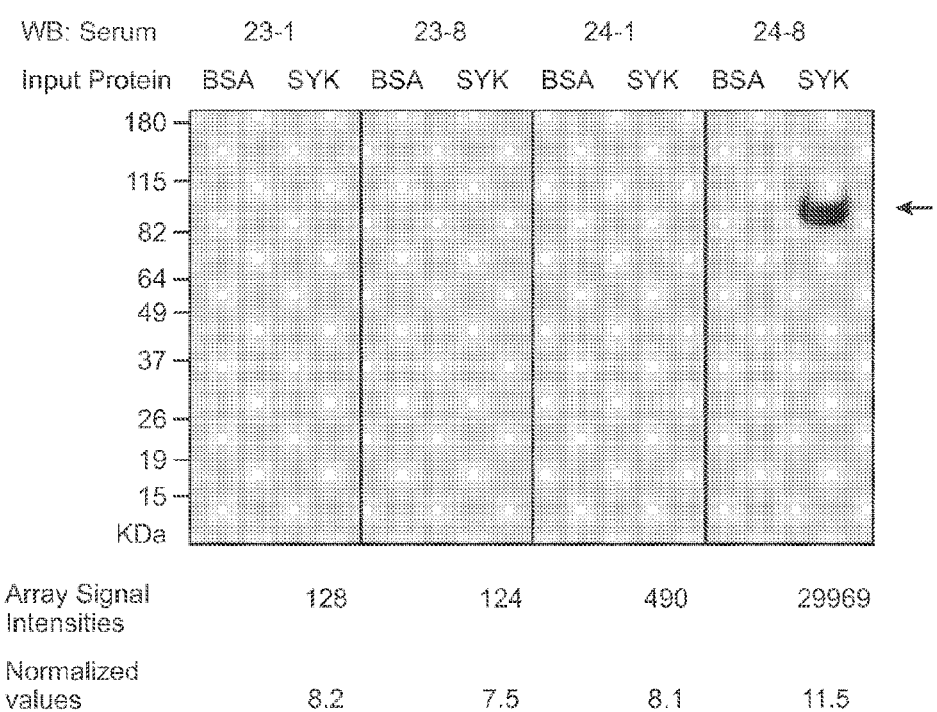
FIG. 1 shows the results of a western blot assay designed to validate an exemplary target antigen.
Figure 2A:
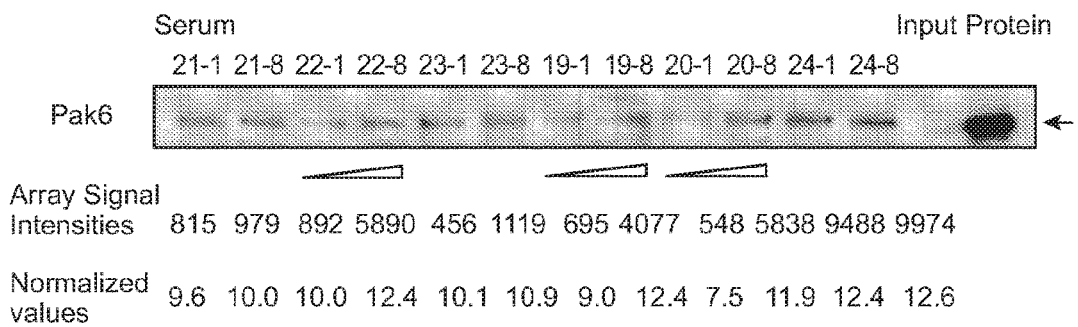
FIGS. 2A-D show the results of immunoprecipitation assays designed to validate exemplary target antigens.
Figure 2B:
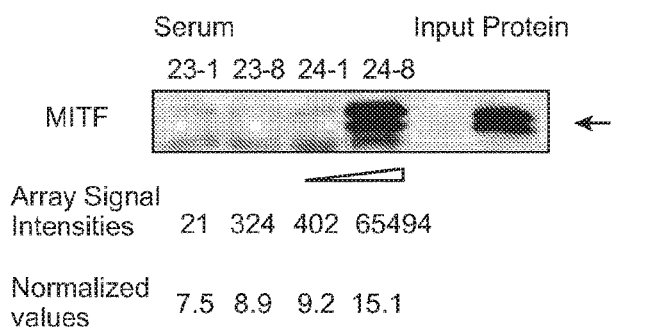
Figure 2C:
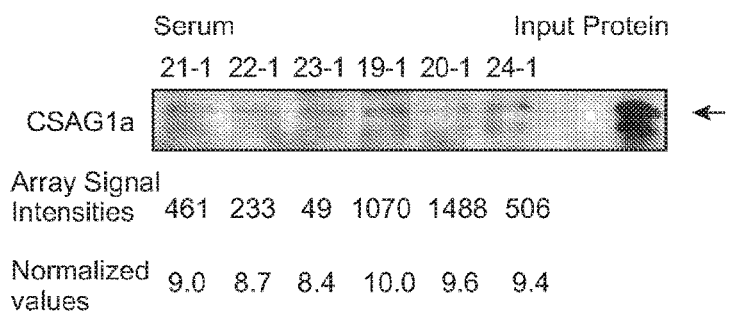
Figure 2D:
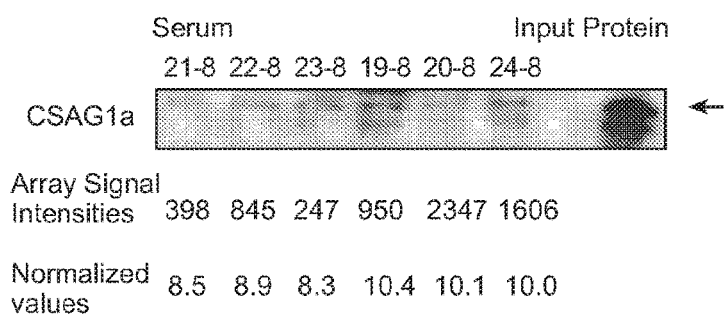

As used herein, a "biological sample" encompasses a variety of sample types obtained from an individual and can be used in a diagnostic or monitoring assay. The term "biological sample" encompasses blood and other liquid samples of biological origin, solid tissue samples such as a biopsy specimen or tissue cultures or cells derived therefrom and the progeny thereof. The term "biological sample" also includes samples that have been manipulated in any way after their procurement, such as by treatment with reagents; washed; or enrichment for certain cell populations, such as $CD4^+$ T lymphocytes. $CD8^+$ T lymphocytes, glial cells, macrophages, tumor cells, peripheral blood mononuclear cells (PBMC), cancer cells, and the like. The term "biological sample" encompasses a clinical sample, and also includes cells in culture, cell supernatants, tissue samples, organs, bone marrow, blood, plasma, serum, cerebrospinal fluid, and the like.

The terms "polypeptide," "peptide," and "protein," used interchangeably herein, refer to a polymeric form of amino acids of any length, which can include coded and non-coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like. $NH_2$ refers to the free amino group present at the amino terminus of a polypeptide. COOH refers to the free carboxyl group present at the carboxyl terminus of a polypeptide. In keeping with standard polypeptide nomenclature, *J. Biol. Chem.*, 243 (1969), 3552-59 is used.

As used herein, the terms "label" and "detectable label" refer to a molecule capable of detection, including, but not limited to, radioactive isotopes, fluorescers, chemiluminescers, chromophores, enzymes, enzyme substrates, enzyme cofactors, enzyme inhibitors, chromophores, dyes, metal ions, metal sols, ligands (e.g., biotin, avidin, strepavidin or haptens), intercalating dyes and the like. The term "fluorescer" refers to a substance or a portion thereof which is capable of exhibiting fluorescence in the detectable range.

As used herein the term "isolated" is meant to describe a polynucleotide, a polypeptide, or a cell that is in an environment different from that in which the polynucleotide, the polypeptide, or the cell naturally occurs. An isolated genetically modified host cell may be present in a mixed population of genetically modified host cells. An isolated polypeptide will in some embodiments be synthetic. "Synthetic polypeptides" are assembled from amino acids, and are chemically synthesized in vitro, e.g., cell-free chemical synthesis, using procedures known to those skilled in the art. An isolated polypeptide will in some embodiments be purified.

By "purified" is meant a compound of interest (e.g., a polypeptide) has been separated from components that accompany it in nature. "Purified" can also be used to refer to a compound of interest (e.g., a polypeptide) separated from components that can accompany it during manufacture (e.g., in chemical synthesis). In some embodiments, a compound (e.g., a polypeptide) is substantially pure when it is at least 50% to 60%, by weight, free from organic molecules with which it is naturally associated or with which it is associated during manufacture. In some embodiments, the preparation is at least 75%, at least 90%, at least 95%, or at least 99%, by weight, of the compound of interest. Thus, e.g., a subject polypeptide that is "purified" is present in a composition where the polypeptide is present in an amount of at least 75%, at least 90%, at least 95%, or at least 99%, by weight, of the composition. A substantially pure compound can be obtained, for example, by extraction from a natural source (e.g., bacteria), by chemically synthesizing a compound, or by a combination of purification and chemical modification. A substantially pure compound can also be obtained by, for example, enriching a sample having a compound that binds an antibody of interest. Purity can be measured by any appropriate method, e.g., chromatography, mass spectroscopy, high performance liquid chromatography analysis, etc.

An "antigen" is a term that is well understood in the art, and includes any substance that may be specifically bound by an antigen-binding site of an antibody molecule or a T cell receptor. An "immunogen" is an antigen that is capable of initiating lymphocyte activation resulting in an antigen-specific immune response.

By "epitope" is meant a site on an antigen to which specific B cells and/or T cells respond. The term is also used interchangeably with "antigenic determinant" or "antigenic determinant site." B cell epitope sites on proteins, polysaccharides, or other biopolymers may be composed of moieties from different parts of the macromolecule that have been brought together by folding. Epitopes of this kind are referred to as conformational or discontinuous epitopes, since the site is composed of segments of the polymer that are discontinuous in the linear sequence but are continuous in the folded conformation(s). Epitopes that are composed of single segments of biopolymers or other molecules are termed continuous or linear epitopes. T cell epitopes are generally linear peptides. Antibodies that recognize the same epitope can be identified in a simple immunoassay showing the ability of one antibody to block the binding of another antibody to a target antigen.

The term "monoclonal antibody" as used herein refers to an antibody obtained from a population of substantially homogeneous antibodies, i.e., the individual antibodies comprising the population are identical except for possible naturally occurring mutations that may be present in minor amounts The monoclonal antibodies included within the scope of the invention include hybrid and recombinant antibodies (e.g. "humanized" antibodies) regardless of species of origin or immunoglobulin class or subclass designation, as well as antibody fragments (e.g., Fab, F(ab')$_2$, and Fv), so long as they are capable of binding specifically to a target antigen as described herein. Cabilly, et al., U.S. Pat. No. 4,816,567; Mage & Lamoyi, in Monoclonal Antibody Production Techniques and Applications, pp. 79-97 (Marcel Dekker. Inc., New York 1987).

Thus, the modifier "monoclonal" indicates the character of the antibody as being obtained from such a substantially homogeneous population of antibodies, and is not to be construed as requiring production of the antibody by any particular method. For example, a monoclonal antibody can be made using the hybridoma method first described by Kohler & Milstein, Nature 256:495 (1975), or may be made by recombinant DNA methods. Cabilly, et al., U.S. Pat. No. 4,816,567.

The terms "cancer," "neoplasm," and "tumor" are used interchangeably herein to refer to cells which exhibit relatively autonomous growth, so that they exhibit an aberrant growth phenotype characterized by a significant loss of control of cell proliferation. Cells of interest for treatment in the present application include precancerous, malignant, pre-metastatic, metastatic, and non-metastatic cells, as well as carcinoma in situ.

"Cancerous phenotype" generally refers to any of a variety of biological phenomena that are characteristic of a cancerous cell, which phenomena can vary with the type of cancer. The cancerous phenotype is generally identified by abnormalities in, for example, cell growth or proliferation (e.g., uncontrolled growth or proliferation), regulation of the cell cycle, cell mobility, cell-cell interaction, or metastasis, etc.

The terms "subject," "individual." "host," and "patient" are used interchangeably herein to refer to a mammal, including, but not limited to, murines (rats, mice), felines, non-human primates (e.g., simians), humans, canines, ungulates, etc.

The terms "treatment." "treating," "treat." and the like are used herein to generally refer to obtaining a desired pharmacologic and/or physiologic effect. The effect may be prophylactic in terms of completely or partially preventing a disease or symptom thereof and/or may be therapeutic in terms of a partial or complete stabilization or cure for a disease and/or adverse effect attributable to the disease. "Treatment" as used herein covers any treatment of a disease in a mammal, particularly a human, and includes: (a) preventing the disease or symptom from occurring in a subject which may be predisposed to the disease or symptom but has not yet been diagnosed as having it; (b) inhibiting the disease symptom, i.e., arresting its development; or (c) relieving the disease symptom, i.e., causing regression of the disease or symptom.

As used herein in the context of patient response to treatment with an immunomodulatory treatment regimen, the terms "beneficial response," "beneficial patient response," and "clinically beneficial response." "clinical benefit," and the like, are used interchangeably and include partial response (PR), complete response (CR), and stabilization of disease (SD).

Beneficial response to treatment with an immunomodulatory treatment regimen can be assessed according to whether an individual patient experiences a desirable change in disease status. Examples of desirable change in disease status in cancer include loss of detectable tumor (complete response. CR), decrease in tumor size and/or cancer cell number (partial response, PR), and tumor growth arrest (stable disease, SD). Continued increase in tumor size and/or cancer cell number and/or tumor metastasis is indicative of lack of beneficial response to treatment.

As used herein, in the context of prostate cancer, the term "responder" refers to a patient who has prostate cancer, and who exhibits a beneficial clinical response following treatment with an immunomodulatory treatment regimen.

As used herein, in the context of prostate cancer, the term "non-responder" refers to a patient who has prostate cancer, and who has not shown a beneficial response following treatment with an immunomodulatory treatment regimen.

As used herein, the term "correlates." or "correlates with," and like terms, refers to a statistical association between instances of two events, where events include numbers, data sets, and the like. For example, when the events involve numbers, a positive correlation (also referred to herein as a "direct correlation") means that as one increases, the other increases as well. A negative correlation (also referred to herein as an "inverse correlation") means that as one increases, the other decreases.

The term "substantially similar" as used in the context of nucleic acid or amino acid sequence identity refers to two or more sequences which have at least about 50%, at least about 60%, at least about 70%, at least about 75%, at least about 80%, at least about 85%, at least about 90%, at least about 95%, at least about 98%, at least about 99%, or 100% sequence identity.

As used herein "% sequence identity" is determined using the EMBOSS Pairwise Alignment Algorithms tool available from The European Bioinformatics Institute (EMBL-EBI), which is part of the European Molecular Biology Laboratory (EMBL). This tool is accessible at the website located by placing "www." in front of "ebi.ac.uk/Tools/emboss/align/". This tool utilizes the Needleman-Wunsch global alignment algorithm (Needleman, S. B, and Wunsch, C. D. (1970) J. Mol. Biol. 48, 443-453; Kruskal, J. B. (1983) An overview of sequence comparison In D. Sankoff and J. B. Kruskal, (ed.), Time warps, string edits and macromolecules: the theory and practice of sequence comparison, pp. 1-44 Addison Wesley. Default settings are utilized which include Gap Open: 10.0 and Gap Extend 0.5. The default matrix "Blosum62" is utilized for amino acid sequences and the default matrix "DNAfull" is utilized for nucleic acid sequences.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "an antigen" includes a plurality of such antigens and reference to "the antibody" includes reference to one or more antibodies and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

The present disclosure provides synthetic antibodies specific for a disease-associated antigen, and methods of using the antibodies in disease therapy. The present disclosure further provides diagnostic assays involving detecting the presence and/or level in biological sample of an antibody specific for a disease-associated antigen. The present disclosure further provides immunogenic compositions comprising disease-associated antigens.

Prostate Cancer Antigens

The present disclosure relates to the observation that individuals who exhibit a clinically beneficial response to an immunomodulatory treatment for prostate cancer can mount an immune response to one or more antigens associated with prostate cancer cells. Identification of the antigens that are the target of such an immune response allows the development of a diagnostic method for determining the likelihood that an individual who has been diagnosed with prostate cancer will exhibit a clinically beneficial response to treatment with an immunomodulatory treatment regimen. Identification of the target antigens also provides for the development of immunogenic compositions comprising a target antigen or a variant or fragment of a target antigen, where administration of such an immunogenic composition to an individual, who has prostate cancer and who has been determined to be less likely to respond to treatment with an immunomodulatory treatment regimen, increases the likelihood that the individual will respond to treatment with an immunomodulatory treatment regimen. Furthermore, identification of target antigens allows generation of therapeutic antibodies for the treatment of prostate cancer.

Target antigens that are the target of an immune response generated in an individual who has prostate cancer and who has exhibited a clinically beneficial response to treatment with an immunomodulatory treatment regimen are also referred to herein as "response indicator antigens" or "prostate cancer-associated target antigens." Antibodies generated in an individual in response to such antigens are referred to herein as "response indicator antibodies" or "prostate cancer-associated response indicator antibodies."

Target antigens are useful in diagnostic assays, as described below, to detect an antibody response in a prostate cancer patient undergoing treatment, e.g., to determine likelihood of beneficial clinical response to treatment with an immunomodulatory treatment regimen. Target antigens are also useful in diagnostic assays, as described below, to detect an antibody response in a prostate cancer patient who has not yet undergone treatment for the prostate cancer. e.g., to determine likelihood of beneficial clinical response to treatment with an immunomodulatory treatment regimen. Target antigens are also useful in immunogenic compositions, to induce an immune response to the target antigen, e.g., in an individual who is determined to be less likely to respond to treatment with an immunomodulatory treatment regimen. Target antigens are also useful for generating therapeutic antibodies, which antibodies are useful for treating prostate cancer.

Immunomodulatory Treatment Regimen

The present disclosure provides methods of assessing the likelihood that a patient having prostate cancer will exhibit a beneficial response to treatment with an immunomodulatory treatment regimen. Patients subject to such an assessment include: 1) patients who have prostate cancer and who have been treated with an immunomodulatory treatment regimen, where treatment with the immununomodulatory treatment regimen was prescribed as a treatment for the prostate cancer; 2) patients who have prostate cancer, who failed treatment with an agent other than an immunomodulatory treatment regimen, and who have begun treatment with an immunomodulatory treatment regimen (e.g., patients with metastatic hormone-refractory prostate cancer); and 3) prostate cancer patient who have not yet received any treatment for the prostate cancer, including prostate cancer patients at any stage of the disease.

In some embodiments, a patient who is being assessed using a subject method is one who is being treated with an immunomodulatory treatment regimen for prostate cancer. Immunomodulatory treatment regimens for the treatment of prostate cancer include any treatment for prostate cancer that modulates an immune response in the individual, e.g., an immune response to a prostate cancer cell. Immunomodulatory treatment regimens include, e.g., hormone therapy, radiation therapy, and immunomodulatory agent therapy.

Hormone therapy for prostate cancer has been reported to have an immununomodulatory effect. See, e.g., Nesslinger et al. (2007) *Clin. Cancer Res.* 13:1493; and Mercader et al. (2001) *Proc. Natl. Acad. Sci USA* 98:14565. Hormone therapy for prostate cancer includes, e.g., luteinizing hormone releasing hormone (LHRH) agonists (e.g., leuprolide (Eligard, Lupron, Viadur); goserelin (Zoladex), triptorelin (Trelstar), etc.); and anti-androgens (e.g., bicalutamide (Casodex), flutamide (Eulexin), nilutamide (Nilandron), etc.).

Immunomodulatory agents for the treatment of prostate cancer include, but are not limited to, an antibody, e.g., anti-CTLA4 (Ipilimumab). CYT 356 (Deb et al. (1996) *Clin Cancer Res* 2: 1289-97). CC49 (see, e.g., Agnese et al. (2004) *Annals Surg. Oncol.* 11:197), C225 (Cetuximab), MT201 (adecatumumab), MLN2704 (anti-PSMA), anti-Ox40 antibody, etc.; a cytokine, e.g., granulocyte-macrophage colony stimulating factor (GM-CSF); and the like. In some embodiments, the antibody is specific for a prostate cancer antigen or epitope. e.g., prostate-specific membrane antigen (PSMA); see, e.g., U.S. Pat. No. 6,107,090. In other embodiments, the antibody is specific for an Ep-CAM (CD326) antigen.

In some embodiments, "an immunomodulatory treatment regimen" includes treatment with two or more agents, one or more of which is an immunomodulatory agent. For example, in some embodiments. "treatment with an immunomodulatory agent" includes treatment with an anti-CTLA4 antibody and GM-CSF. For example, in some embodiments, "treatment with an immununomodulatory agent" includes treatment with an antibody for the treatment of prostate cancer, and a small molecule anti-cancer chemotherapeutic agent. In some embodiments, "an immunomodulatory treatment regimen" includes a combination of radiation therapy and hormone therapy. In some embodiments, "an immunomodulatory treatment regimen" includes a combination of radiation therapy and treatment with one or more immunomodulatory agents. In some embodiments, "an immunomodulatory treatment regimen" includes a combination of hormone therapy and treatment with one or more immunomodulatory agents.

Antigens

Target antigens that are the target of an immune response generated in an individual who has prostate cancer and who has exhibited a clinically beneficial response to treatment with an immunomodulatory treatment regimen include, but are not limited to, those shown in Table 1, below.

TABLE 1

| Name | GenBank Accession No. | Name | GenBank Accession No. |
|---|---|---|---|
| NTRK3 | NM_002530 | MRPL19 | NM_014763 |
| AURKB | NM_004217 | MITF | BC011461 |
| PLK3 | NM_004073 | C15orf38 | BC053602 |
| MPG | BC014991 | HN1 | NM_016185 |
| NEK2 | NM_002497 | DCAMKL2 | NM_152619 |
| SNURF | NM_005678 | SYK | NM_003177 |
| ACLY | BC006195 | MGC11082 | NM_032691 |
| CaMKIId | NM_001221 | CAMK2N2 | NM_033259 |
| PAK6 | NM_020168 | AMMECR1L | NM_031445 |
| CSNK1D | NM_001893 | UBE2V1 | BC000468 |
| CSNK1G2 (CK1g2) | NM_001319 | ZNF434 | BC002859 |
| SMTNL2 | NM_198501 | IKIP | NM_201613 |
| MARK4 | NM_031417 | AKT1 | BC000479 |
| GTSF1 | NM_144594 | CAMKIIN1 | NM_018584 |
| MLLT6/AF-7 | BC064612 | AXL | NM_001699 |
| RET | NM_020630 | AURKA | NM_003600 |
| CSAG1a | BC059947 | KIT | NM_000222 |
| WAC | B010356 | CSNK1G1 | NM_022048 |
| TMEPAI | NM_0201182 | CSNK1E | NM_001894 |
| AKT2 | NM_001626 | CCNT1 | NM_001240 |
| AIF1 | NM_001623 | PAK4 | NM_005884 |
| AFF4 | BC025700 | C19orf57 | BC012945.1 |
| CDK9 | NM_001240 | Tox2 | NM_032883.1 |
| TPRXL | BC027729 | ASPSCR1 | BC018722.1 |
| STK22B | NM_053006 | GSK3A | NM_019884 |
| NUAK1 | NM_014840 | RSK1 | NM_001006665 |
| MARK2 | NM_001039468 | FGF21 | BC018404.1 |
| AXL | NM_001699 | RIPPLY1 | NM_138382 |
| CDK1 | NM_001786 | ALDH7A1 | NM_001182.2 |
| G3BP1 | NM_198395 | UBXN10 | NM_152376.2 |
| MPG | BC014991 | CAMK2B | NM_001220 |
| SLAIN | BC031691 | BAG5 | BC050551.1 |
| PPID | NM_005038 | FAM129A | NM_052966 |
| C3orf37 | BC010125 | cortactin (CTTN) | NM_138565.1 |
| MAPK13 | NM_002754 | ErbB2 (HER2) | NM_001005862 |
| IKBIP | NM_201613 | TPM1 | BC053545.1 |
| KIR3DX1 | BC033195 | ANKS6 | BC064367.1 |
| LMCD1 | NM_014583 | ITGA6 | NM_000210.1 |
| C1orf116 | NM_023938.4 | TCEAL2 | NM_080390.3 |
| GSK3B | NM_002093 | IGKV1-5 | BC030814.1 |
| sulfatase 1 | BC012997.2 | TPM2 | BC011776.1 |

The present disclosure provides an isolated target antigen, antigenic fragments of a target antigen, and variants of a target antigen. In some embodiments, a subject target antigen is synthetic, e.g., a subject synthetic target antigen is synthesized chemically in a laboratory.

In some embodiments, a subject target antigen comprises from about 6, 7, 8, 9, 10, 11, 12, 13-15, 15-17, 17-20, from 20 to 25, from 25 to 50, from 50 to 75, from 75 to 100, or from 100 to 150, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in one of the following GenBank Accession Numbers: NM_002530. NM_004217, NM_004073, BC014991, NM_002497, NM_005678, BC006195, NM_001221. NM_020168, NM_001893, NM_001319, NM_198501, NM_031417, NM_144594, BC064612, NM_020630, BC059947, B010356, NM_0201182, NM_001626, NM_001623, NM_014763, BC011461, BC053602, NM_016185, NM_152619, NM_003177, NM_032691, NM_033259, NM_031445, BC000468, BC002859, NM_201613, BC000479, NM_018584, NM_001699, NM_003600, NM_000222, NM_022048, NM_001894, NM_001240 NM_005884, BC025700, NM_001240, BC027729, NM_053006, NM_014840, NM_001039468, NM_001699, NM_001786, NM_198395, BC014991, BC031691, NM_005038, BC010125, NM_002754, NM_201613, BC033195, NM_014583, NM_023938.4, NM_002093, BC012997.2, BC012945.1, NM_032883.1, BC018722.1. NM_019884, NM_001006665, BC018404.1, NM_138382, NM_001182.2, NM_152376.2, NM_001220, BC050551.1, NM_052966, NM_138565.1, NM_001005862, BC053545.1, BC064367.1, NM_000210.1, NM_080390.3, BC030814.1, and BC011776.1.

In some embodiments, a subject target antigen comprises from about 6, 7, 8, 9, 10, 11, 12, 13-15, 15-17, 17-20, from 20 to 25, from 25 to 50, from 50 to 75, from 75 to 100, or from 100 to 150, or more, contiguous amino acids (aa) of an amino acid sequence having at least about 50, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in one of SEQ ID NOs:1-42 and 108-147.

For example, in some embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, from about 500 aa to about 750 aa, from about 750 aa to about 800 aa, or from about 800 aa to about 825 aa, of the amino acid sequence set forth in SEQ ID NO:1 (NTRK3). In some of these embodiments, the target antigen will have a length of from about 5 aa to about 10 aa, from about 10 aa to about 25 aa, from about 25 aa to about 50 aa, from about 50 aa to about 100 aa, from about 100 an to about 150 aa, from about 150 aa to about 200 aa, from about 200 as to about 250 aa, from about 250 aa to about 500 aa, from about 500 aa to about 750 aa, from about 750 aa to about 800 aa, or from about 800 aa to about 825 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 344 aa, of the amino acid sequence set forth in SEQ ID NO:2 (AURKB). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 344 an.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, or from about 500 an to about 646 aa, of the amino acid sequence set forth in SEQ ID NO:3 (PLK3). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, from about 500 aa to about 646 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, or from about 250 aa to about 293 aa, of the amino acid sequence set forth in SEQ ID NO:4 (MPG). In some of these embodiments, the target antigen will have a length of from about 5 aa to about 10 aa, from about 10 as to about 25 aa, from about 25 aa to about 50 aa, from about 50 aa to about 100 aa, from about 100 aa to about 150 aa, from about 150 aa to about 200 aa, from about 200 aa to about 250 aa, or from about 250 aa to about 293 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 445 aa, of the amino acid sequence set forth in SEQ ID NO:5 (NKE2). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 as to about 250 aa, from about 250 aa to about 300 aa, or from about 300 aa to about 445 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, or from about 50 aa to about 71 aa, of the amino acid sequence set forth in SEQ ID NO:6

(SNURF). In some of these embodiments, the target antigen will have a length of from about 5 aa to about 10 aa, from about 10 aa to about 25 aa, from about 25 as to about 50 aa, or from about 50 an to about 71 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa from about 50 aa to about 100 aa, from about 100 aa to about 150 aa, from about 150 an to about 200 aa, from about 200 aa to about 250 aa, from about 250 aa to about 300 aa, from about 300 aa to about 400 aa, from about 400 aa to about 500 aa, from about 500 aa to about 600 aa, from about 600 aa to about 700 aa from about 700 aa to about 800 aa, from about 800 aa to about 900 aa, from about 900 aa to about 1000 aa, or from about 1000 aa to about 1101 aa, of the amino acid sequence set forth in SEQ ID NO:7 (ACLY). In some of these embodiments, the target antigen will have a length of from about 5 aa to about 10 aa, from about 10 aa to about 25 an, from about 25 aa to about 50 aa, from about 50 aa to about 100 aa, from about 100 an to about 150 aa, from about 150 aa to about 200 aa, from about 200 aa to about 250 aa, from about 250 aa to about 300 aa, from about 300 aa to about 400 aa, from about 400 aa to about 500 aa, from about 500 aa to about 600 aa, from about 600 aa to about 700 aa, from about 700 aa to about 800 aa, from about 800 aa to about 900 aa, from about 900 aa to about 1000 aa, or from about 1000 aa to about 1101 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 an to about 200 aa, from about 200 aa to about 250 aa, from about 250 aa to about 300 aa, from about 300 aa to about 400 aa, or from about 400 aa to about 499 aa, of the amino acid sequence set forth in SEQ ID NO:8 (CaMKIId). In some of these embodiments, the target antigen will have a length of from about 5 am to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, or from about 400 aa to about 499 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, from about 400 aa to about 500 aa, from about 500 aa to about 600 aa, or from about 600 an to about 681 aa, of the amino acid sequence set forth in SEQ ID NO:9 (PAK6). In some of these embodiments, the target antigen will have a length of from about 5 aa to about 10 aa, from about 10 aa to about 25 aa, from about 25 aa to about 50 aa, from about 50 an to about 100 aa, from about 100 aa to about 150 aa, from about 150 aa to about 200 aa, from about 200 aa to about 250 aa, from about 250 aa to about 300 aa, from about 300 aa to about 400 an, from about 400 aa to about 500 aa, from about 500 aa to about 600 aa, or from about 600 aa to about 681 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, or from about 400 aa to about 415 aa, of the amino acid sequence set forth in SEQ ID NO:10 (CSNK1D). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, or from about 400 aa to about 415 an.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, or from about 400 aa to about 415 aa, of the amino acid sequence set forth in SEQ ID NO:11 (CSNKIG2). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 an, from about 150 aa to about 200 aa, from about 200 aa to about 250 aa from about 250 aa to about 300 aa, from about 300 aa to about 400 aa, or from about 400 aa to about 415 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 317 aa, of the amino acid sequence set forth in SEQ ID NO: 12 (SMTNL2). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 an to about 250 aa, from about 250 aa to about 300 aa, or from about 300 aa to about 317 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 317 aa, of the amino acid sequence set forth in SEQ ID NO: 13 (MARK4). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 as, from about 200 aa to about 250 aa, from about 250 aa to about 300 aa, from about 300 aa to about 400 aa; from about 400 aa to about 500 aa, from about 500 aa to about 600 aa, or from about 600 aa to about 688 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, or from about 150 aa to about 167 aa, of the amino acid sequence set forth in SEQ ID NO:14 (GTSF1). In some of these embodiments, the target antigen will have a length of from about 5 aa to about 10 aa, from about 10 aa to about 25 aa, from about 25 aa to about 50 aa, from about 50 aa to about 100 aa, from about 10 aa to about 150 aa, or from about 150 aa to about 167 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 325 aa, of the amino acid sequence set forth in SEQ ID NO: 15 (MLLT6/AF-7). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 325 an.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, front about 50 aa to about 100 aa, from about 100 aa to about 150 aa, from about 150 aa to about 200 aa, from about 200 aa to about 250 aa, from about 250 aa to about 300 aa, from about 300 aa to about 400 aa, from about 400 aa to about 500 aa, from about 500 aa to about 600 aa, from about 600 aa to about 700 aa, from about 700 aa to about 800 aa, from about 800 aa to about 900 aa, from about 900 aa to about 1000 aa, or from about 1000 aa to about 1072 aa, of the amino acid sequence set forth in SEQ ID NO: 16 (RET). In some of these embodiments, the target antigen will have a length of from about 5 aa to about 10 aa, from about 10 aa to about 25 an, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, from about 400 aa to about 500 aa from about 500 aa to about 600 aa, from about 600 aa to about 700 aa, from about 700 aa to about 800 aa, from about 800 aa to about 900 aa, from about 900 aa to about 1000 aa, or from about 1000 aa to about 1072 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 an to about 25 aa, from about 25 aa to about 50 aa, from about 50 aa to about 75 aa, or from about 75 as to about 78 aa, of the amino acid sequence set forth in SEQ ID NO:17 (CSAG1a). In some of these embodiments, the target antigen will have a length of from about 5 an to about 10 aa, from about 10 an to about 25 aa, from about 25 aa to about 50 aa, from about 50 aa to about 75 aa, or from about 75 aa to about 78 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, or from about 200 aa to about 210 aa, of the amino acid sequence set forth in SEQ ID NO: 18 (WAC). In some of these embodiments, the target antigen will have a length of from about 5 aa to about 10 aa, from about 10 aa to about 25 aa, from about 25 as to about 50 aa, from about 50 aa to about 100 aa, from about 100 aa to about 150 aa, from about 150 as to about 200 aa, or from about 200 aa to about 210 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, or from about 200 an to about 287 aa, of the amino acid sequence set forth in SEQ ID NO: 19 (TMEPAI). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, or from about 200 aa to about 287 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa from about 300 aa to about 400) a, or from about 400 aa to about 481 aa, of the amino acid sequence set forth in SEQ ID NO:20 (AKT2). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, or from about 400 aa to about 481 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, or from about 100 aa to about 147 aa, of the amino acid sequence set forth in SEQ ID NO:21 (AIF1). In some of these embodiments, the target antigen will have a length of from about 5 aa to about 10 aa, from about 10 as to about 25 aa, from about 25 aa to about 50 aa, from about 50 aa to about 100 aa, or from about 100 aa to about 147 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, or from about 200 aa to about 292, of the amino acid sequence set forth in SEQ ID NO:22 (MRPL19). In some of these embodiments, the target antigen will have a length of from about 5 aa to about 10 aa, from about 10 aa to about 25 aa, from about 25 as to about 50 aa, from about 50 aa to about 100 aa, from about 100 aa to about 150 aa, from about 150 aa to about 200 aa, or from about 200 aa to about 292.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 15 aa, from about 15 aa to about 20 aa or from about 20 aa to about 23 aa, of the amino acid sequence set forth in SEQ ID NO:23 (MITF). In some of these embodiments, the target antigen will have a length of from about 5 aa to about 10 aa, from about 10 aa to about 15 aa, from about 15 as to about 20 aa, or from about 20 an to about 23 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, or from about 200 aa to about 226 aa, of the amino acid sequence set forth in SEQ ID NO:24 (C15orf38). In some of these embodiments, the target antigen will have a length of from about 5 aa to about 10 aa, from about 10 aa to about 25 aa, from about 25 aa to about 50 aa, from about 50 an to about 100 aa, from about 100 aa to about 150 aa, from about 150 as to about 200 aa, or from about 200 aa to about 226 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 an to about 50 aa, from about 50 aa to about 100 aa, from about 100 aa to about 150 aa, or from about 150 an to about 154 aa, of the amino acid sequence set forth in SEQ ID NO:25 (HN1). In some of these embodiments, the target antigen will have a length of from about 5 as to about 10 aa, from about 10 aa to about 25 aa, from about 25 aa to about 50 aa, from about 50 aa to about 100 aa, from about 100 aa to about 150 aa, or from about 150 aa to about 154 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, from about 400 aa to about 500 aa; from about 500 aa to about 600 aa, or from about 600 aa to about 695 aa, of the amino acid sequence set forth in SEQ ID NO:26 (DCAMKL2). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, from about 400 aa to about 500 aa; from about 500 aa to about 600 as, or from about 600 aa to about 695 an.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, from about 400 aa to about 500 aa; from about 500 aa to about 600 aa, or from about 600 aa to about 635 aa, of the amino acid sequence set forth in SEQ ID NO:27 (SYK). In some of these embodiments, the target antigen will have a length of from about 5 aa to about 10 aa, from about 10 as to about 25 aa, from about 25 aa to about 50 aa, from about 50 aa to about 100 aa, from about 100 aa to about 150 aa, from about 150 aa to about 200 aa, from about 200 aa to about 300 aa, from about 300 as to about 400 aa, from about 400 aa to about 500 aa; from about 500 aa to about 600 aa, or from about 600 aa to about 635 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 75 aa, or from about 75 as to about 88 aa, of the amino acid sequence set forth in SEQ ID NO:28 (MGC11082). In some of these embodiments, the target antigen will have a length of from about 5 aa to about 10 aa, from about 10 as to about 25 aa, from about 25 aa to about 50 aa, from about 50 aa to about 75 aa, or from about 75 aa to about 88 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 75 aa, or from about 75 as to about 79 aa, of the amino acid sequence set forth in SEQ ID NO:29 (CAMK2N2). In some of these embodiments, the target antigen will have a length of from about 5 aa to about 10 aa, from about 10 as to about 25 aa, from about 25 aa to about 50 aa, from about 50 aa to about 75 aa, or from about 75 aa to about 79 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, or from about 300 aa to about 310 aa, of the amino acid sequence set forth in SEQ ID NO:30 (AMMECR1L). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, or from about 300 aa to about 310 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, or from about 100 aa to about 147 aa, of the amino acid sequence set forth in SEQ ID NO:31 (UBE2V1). In some of these embodiments, the target antigen will have a length of from about 5 aa to about 10 aa, from about 10 aa to about 25 aa, from about 25 aa to about 50 aa, from about 50 aa to about 100 aa, or from about 100 aa to about 147 an.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, or from about 200 aa to about 256 aa, of the amino acid sequence set forth in SEQ ID NO:32 (ZNF434). In some of these embodiments, the target antigen will have a length of from about 5 aa to about 10 aa, from about 10 aa to about 25 aa, from about 25 as to about 50 aa, from about 50 aa to about 100 aa, from about 100 aa to about 150 aa, from about 150 as to about 200 aa, or from about 200 aa to about 256 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 60 aa, or from about 60 as to about 70 aa, of the amino acid sequence set forth in SEQ ID NO:33 (IKIP). In some of these embodiments, the target antigen will have a length of from about 5 aa to about 10 aa, from about 10 aa to about 25 aa, from about 25 aa to about 50 aa, from about 50 aa to about 60 aa, or from about 60 aa to about 70 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, or from about 400 aa to about 480 aa, of the amino acid sequence set forth in SEQ ID NO:34 (AKT1). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, or from about 400 aa to about 480 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 60 aa, from about 60 aa to about 70 aa, or from about 70 aa to about 78 aa, of the amino acid sequence set forth in SEQ 11) NO:35 (CAMKIIN1). In some of these embodiments, the target antigen will have a length of from about 5 aa to about 10 aa, from about 10 aa to about 25 aa, from about 25 aa to about 50 aa, from about 50 aa to about 60 aa, from about 60 aa to about 70 aa, or from about 70 aa to about 78 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, from about 400 aa to about 500 aa, from about 500 aa to about 600 aa, from about 600 aa to about 700 aa, from about 700 aa to about 800 aa, or from about 800 aa to about 885 aa, of the amino acid sequence set forth in SEQ ID NO:36 (AXL). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 an, from about 400 an to about 500 aa, from about 500 aa to about 600 aa from about 600 aa to about 700 aa, from about 700 aa to about 800 aa or from about 800 aa to about 885 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, or from about 300 aa to about 403 aa, of the amino acid sequence set forth in SEQ ID NO:37 (AURKA). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, or from about 300 aa to about 403 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, from about 400 aa to about 500 aa, from about 500 aa to about 600 aa, from about 600 aa to about 700 aa, from about 700 aa to about 800 aa, from about 800 aa to about 900 aa, or from about 900 aa to about 976 aa, of the amino acid sequence set forth in SEQ ID NO:38 (KIT). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, from about 400 an to about 500 aa, from about 500 aa to about 600 aa, from about 600 aa to about 700 aa, from about 700 aa to about 800 aa, from about 800 aa to about 900 aa, or from about 900 aa to about 976 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, or from about 400 aa to about 422 aa, of the amino acid sequence set forth in SEQ ID NO:39 (CSNK1G1). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 an to about 300 aa from about 300 aa to about 400 aa, or from about 400 aa to about 422 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, or from about 400 an to about 416 aa, of the amino acid sequence set forth in SEQ ID NO:40 (CSNK1E). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, or from about 400 aa to about 416 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, from about 400 aa to about 500 aa, from about 500 aa to about 600 aa, from about 600 aa to about 700 aa, or from about 700 aa to about 726 aa, of the amino acid sequence set forth in SEQ ID NO:41 (CCNT1). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, from about 400 aa to about 500 aa, from about 500 aa to about 600 aa, from about 600 aa to about 700 aa, or from about 700 aa to about 726 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, from about 400 aa to about 500 aa, or from about 500 aa to about 591 aa, of the amino acid sequence set forth in SEQ ID NO:42 (PAK4). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 300 aa, from about 300 aa to about 400 aa, from about 400 aa to about 500 aa, or from about 500 aa to about 591 aa.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, or from about 250 aa to about 365 aa, of the amino acid sequence set forth in SEQ ID NO: 108 (AFF4). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, or from about 250 aa to about 365 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200) aa, from about 200) aa to about 250 aa, from about 250 aa to about 500 aa, from about 500) aa to about 600 aa, or from about 600 aa to about 726 aa of the amino acid sequence set forth in SEQ ID NO: 109 (CDK9). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, from about 500 aa to about 600 aa, or from about 600 aa to about 726 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, or from about 200 aa to about 258 an of the amino acid sequence set forth in SEQ ID NO: 110 (TPRXL). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 an to about 200 aa, or from about 200 aa to about 258 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 358aa, of the amino acid sequence set forth in SEQ ID NO: 111 (STK22B). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 an to about 250 aa, from about 250 aa to about 300 aa, or from about 300 aa to about 358 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, or from about 500 aa to about 661 aa, of the amino acid sequence set forth in SEQ ID NO: 112 (NUAK1). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, or from about 500 aa to about 661 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 an to about 500 aa, from about 500 aa to about 600, from about 600 aa to about 700 aa, or from about 700 aa to about 724 aa, of the amino acid sequence set forth in SEQ ID NO: 113 (MARK2). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, from about 500 aa to about 600, from about 600 aa to about 700, or from about 700 to about 724 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 an to about 100 aa, from about 100 aa to about 150 aa, from about 150 aa to about 200 aa, from about 200 aa to about 250 aa, from about 250 aa to about 500 aa, from about 500 aa to about 600 aa, from about 600 aa to about 700 aa, from about 700 an to about 800 aa, or from about 800 aa to about 885 aa, of the amino acid sequence set forth in SEQ ID NO: 114 (AXL). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, from about 500 aa to about 600 aa, from about 600 aa to about 700 aa, from about 700 aa to about 800 aa, or from about 800 aa to about 885 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, or from about 250 aa to about 297 aa, of the amino acid sequence set forth in SEQ ID NO: 115 (CDK1). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, or from about 250 aa to about 297 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, or from about 400 aa to about 466 aa, of the amino acid sequence set forth in SEQ ID NO: 116 (G3BP1). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 an to about 200 aa, from about 200 aa to about 250 aa, from about 250 aa to about 300 aa, from about 300 an to about 400 aa, or from about 400 aa to about 466 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, or from about 250 aa to about 298 aa, of the amino acid sequence set forth in SEQ ID NO: 117 (MPG). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, or from about 250 aa to about 298 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, or from about 500 aa to about 581 aa, of the amino acid sequence set forth in SEQ ID NO: 118 (SLAIN). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, or from about 500 aa to about 581 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 370 aa, of the amino acid sequence set forth in SEQ ID NO: 119 (PPID). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 370 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 354 aa, of the amino acid sequence set forth in SEQ ID NO: 120 (C3orf37). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 354 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 365 aa, of the amino acid sequence set forth in SEQ ID NO: 121 (MAPK13). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 as, from about 200 aa to about 250 aa, from about 250 aa to about 300 aa, or from about 300 aa to about 365 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, or from about 50 aa to about 77 aa, of the amino acid sequence set forth in SEQ ID NO: 122 (IKBIP). In some of these embodiments, the target antigen will have a length of from about 5 aa to about 10 aa, from about 10 aa to about 25 aa, from about 25 as to about 50 aa, or from about 50 aa to about 77 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 352 aa, of the amino acid sequence set forth in SEQ ID NO: 123 (KIR3DX1). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 352 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100 amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 365 aa, of the amino acid sequence set forth in SEQ ID NO: 124 (LMCD1). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 an to about 300 aa, or from about 300 aa to about 365 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 an to about 50 aa, from about 50 aa to about 100 aa, from about 100 aa to about 150 aa, from about 150 aa to about 200 aa, from about 200 aa to about 250 aa, from about 250 aa to about 500 aa, or from about 500 aa to about 601 aa, of the amino acid sequence set forth in SEQ ID NO: 125 (C1orf116). In some of these embodiments, the target antigen will have a length of from about 5 aa to about 10 aa, from about 10 aa to about 25 aa, from about 25 aa to about 50 aa, from about 50 an to about 100 aa, from about 100 aa to about 150 aa, from about 150 an to about 200 aa, from about 200 aa to about 250 aa, from about 250 aa to about 500 aa, or from about 500 aa to about 601 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, or from about 400 aa to about 433 aa, of the amino acid sequence set forth in SEQ ID NO: 126 (GSK3B). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 an to about 200 aa, from about 200 aa to about 250 aa, from about 250 aa to about 300 an, from about 300 aa to about 400, or from about 400 aa to about 433 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, or from about 25 aa to about 44 aa, of the amino acid sequence set forth in SEQ ID NO: 127 (sulfatase 1). In some of these embodiments, the target antigen will have a length of from about 5 aa to about 10 aa, from about 10 aa to about 25 aa, or from about 25 aa to about 44 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, or from about 500 aa to about 546 aa, of the amino acid sequence set forth in SEQ ID NO: 128 (C19orf57). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, or from about 500 aa to about 546 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, or from about 400 aa to about 553 aa, of the amino acid sequence set forth in SEQ ID NO: 129 (Tox2). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400, or from about 400 aa to about 553 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, or from about 500 aa to about 553 aa, of the amino acid sequence set forth in SEQ ID NO: 130 (ASPSCR1). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 an to about 250 aa, from about 250 aa to about 500 aa, or from about 500 aa to about 553 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, or about 400 aa to about 483 aa, of the amino acid sequence set forth in SEQ ID NO: 131 (GSK3A). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 an to about 400 aa, or from about 400 aa to about 483 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, from about 500 aa to about 600 aa, from about 600 aa to about 700 aa, or from about 700 aa to about 744 aa, of the amino acid sequence set forth in SEQ ID NO: 132 (RSK1). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, from about 500 aa to about 600 aa, from about 600 aa to about 700 aa, or from about 700 aa to about 744 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 an to about 100 aa, from about 100 aa to about 150 aa, or from about 150 aa to about 209 aa, of the amino acid sequence set forth in SEQ ID NO: 133 (FGF21). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, or from about 150 aa to about 209 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, or from about 100 aa to about 151 aa, of the amino acid sequence set forth in SEQ ID NO: 134 (RIPPLY1). In some of these embodiments, the target antigen will have a length of from about 5 aa to about 10 aa, from about 10 aa to about 25 aa, from about 25 aa to about 50 aa, or from about 50 aa to about 100 aa, from about 100 aa to about 151 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, or from about 400 aa to about 511 aa, of the amino acid sequence set forth in SEQ ID NO: 135 (ALDH7A1). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, or from about 400 aa to about 511 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, or from about 250 aa to about 280 aa, of the amino acid sequence set forth in SEQ ID NO: 136 (UBXN10). In some of these embodiments, the target antigen will have a length of from about 5 aa to about 10 aa, from about 10 aa to about 25 aa from about 25 aa to about 50 aa, from about 50 aa to about 100 aa, from about 10 aa to about 150 aa, from about 150 aa to about 200 aa, from about 200 aa to about 250 aa, or from about 250 aa to about 280 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, from about 500 aa to about 600 aa, or from about 600 aa to about 666 aa, of the amino acid sequence set forth in SEQ ID NO: 137 (CAMK2B). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, from about 500 aa to about 600 aa, or from about 600 aa to about 666 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, from about 300 aa to about 400 aa, or from about 400 aa to about 488 aa, of the amino acid sequence set forth in SEQ ID NO: 138 (BAG5). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 an to about 300 aa, from about 300 aa to about 400 aa, or from about 400 aa to about 488 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, from about 500 aa to about 600 aa, from about 600 aa to about 800 aa, or from about 800 aa to about 928 aa, of the amino acid sequence set forth in SEQ ID NO: 139 (FAM129A). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 20 aa, from about 200) aa to about 250 aa, from about 250 aa to about 500 aa, from about 500 aa to about 600 aa, from about 600 aa to about 800 as, or from about 800 aa to about 928 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, or from about 500 aa to about 550 aa, of the amino acid sequence set forth in SEQ ID NO: 140 (cortactin). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, or from about 500 aa to about 550 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, or from about 500 aa to about 600 aa, from about 600 aa to about 800 aa, from about 800 aa to about 1000 aa, or from about 1000 aa to about 1255 aa, of the amino acid sequence set forth in SEQ ID NO: 141 (ErbB2). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, from about 500 aa to about 600 aa, from about 600 aa to about 800 aa, from about 800 aa to about 1000 aa, or from about 1000 aa to about 1255 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, or from about 250 aa to about 284 aa of the amino acid sequence set forth in SEQ ID NO: 142 (TPM1). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa or from about 250 aa to about 284 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 471 aa, of the amino acid sequence set forth in SEQ ID NO: 143 (ANKS6). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 300 aa, or from about 300 aa to about 471 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa from about 50 aa to about 100 aa, from about 100 aa to about 150 aa, from about 150 aa to about 200 aa, from about 200 aa to about 250 aa, from about 250 aa to about 500 aa, or from about 500 aa to about 600 aa, from about 600 aa to about 800 aa, from about 800 aa to about 1000 aa, or from about 1000 aa to about 1073 aa, of the amino acid sequence set forth in SEQ ID NO: 144 (ITGA6). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, from about 250 aa to about 500 aa, from about 500 aa to about 600 aa, from about 600 aa to about 800 aa, from about 800 aa to about 1000 aa, or from about 1000 aa to about 1073 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, or from about 200 aa to about 227 aa, of the amino acid sequence set forth in SEQ ID NO: 145 (TCEAL2). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 an to about 200 aa, or from about 200 aa to about 227 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, or from about 100 aa to about 117 aa, of the amino acid sequence set forth in SEQ ID NO: 146 (IGKV1-5). In some of these embodiments, the target antigen will have a length of from about 5 aa to about 10 aa, or from about 10 aa to about 25 aa, from about 25 aa to about 50 aa, from about 50 aa to about 100 aa, from about 100 aa to about 117 amino acids.

In other embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to a contiguous stretch of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, or from about 250 aa to about 284 aa, of the amino acid sequence set forth in SEQ ID NO: 147 (TPM2). In some of these embodiments, the target antigen will have a length of from about 5 aa to about 10 aa, from about 10 aa to about 25 aa, from about 25 aa to about 50 aa, from about 50 aa to about 100 aa, from about 100 aa to about 150 aa, from about 150 aa to about 200 aa, from about 200 aa to about 250 aa, or from about 250 aa to about 284 amino acids.

A subject target antigen will in some embodiments have a length of from about 5 amino acids to about 10 aa, from about 10 aa to about 15 aa, from about 15 aa to about 20 aa, from about 20 aa to about 25 aa, from about 25 aa to about 30 aa, from about 30 aa to about 40 aa, or from about 40 aa to about 50 aa. In some embodiments, a subject target antigen will have a length of from about 50 aa to about 75 aa, from about 75 aa to about 100 aa, from about 100 aa to about 150 aa, or from about 150 as to about 200 aa.

In some embodiments, a subject prostate cancer-associated target antigen differs in amino acid sequence by 1, 2, 3, 4, 5, 6, 7, 8, 9, 10, from 10 to 15, from 15 to 20, or from 20 to 25, amino acids compared to the amino acid sequence set forth in any one of SEQ ID NOs: 1-42 and 108-147.

Panel

The present disclosure provides a panel of 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, about 45, about 50, about 60, about 70, or about 82 of the above-described prostate cancer-associated target antigens or isolated target antigens. A subject panel is useful for detecting in a biological sample the presence of antibody to the two or more antigens.

In some embodiments, two or more of the target antigens will be detectably labeled with distinguishable detectable labels, e.g., a first target antigen is labeled with a first detectable label, a second target antigen is labeled with a second detectable label, etc., where the first and the second (and any additional) detectable labels are distinguishable from one another.

In some embodiments, a subject panel comprises two or more prostate cancer-associated target antigens, where the antigens are immobilized on an insoluble support.

Detectable Labels

In some embodiments, a subject target antigen comprises a detectable label. Suitable labels include radioisotopes (e.g., $^{125}$I; $^{35}$S, and the like): enzymes whose products are detectable (e.g., luciferase, β-galactosidase, horse radish peroxidase, alkaline phosphatase, and the like); fluorescent labels (e.g., fluorescein isothiocyanate, rhodamine, phycoerythrin, and the like); fluorescence emitting metals, e.g., $^{152}$Eu, or others of the lanthanide series, attached to the antibody through metal chelating groups such as EDTA; chemiluminescent compounds, e.g., luminol, isoluminol, acridinium salts, and the like: bioluminescent compounds, e.g., luciferin; fluorescent proteins; and the like. Suitable fluorescent proteins include, but are not limited to, a green fluorescent protein (GFP), including, but not limited to, a GFP derived from *Aequoria victoria* or a derivative thereof, a number of which are commercially available; a GFP from a species such as *Renilla reniformis, Renilla mulleri*, or *Ptilosarcus guernyi*, as described in, e.g., WO 99/49019 and Peelle et al. (2001) *J. Protein Chem.* 20:507-519; any of a variety of fluorescent and colored proteins from Anthozoan species, as described in. e.g., Matz et al. (1999) *Nature Biotechnol.* 17:969-973, U.S. Patent Publication No. 2002/0197676, or U.S. Patent Publication No. 2005/0032085; and the like.

Carriers

In some embodiments, a subject target antigen is linked to a carrier. The term "linked," as used herein interchangeably with the term "coupled," refers to proximately associated, e.g., the subject target antigen and the carrier are in close spatial proximity. In some embodiments, the linkage is a covalent linkage. In other embodiments, the linkage is a non-covalent linkage. In some embodiments, the subject target antigen is linked directly to the carrier. In other embodiments, the subject target antigen is linked indirectly. e.g., via a linker molecule.

Examples of suitable carriers include large, slowly metabolized macromolecules such as: proteins; polysaccharides, such as sepharose, agarose, cellulose, cellulose beads and the like; polymeric amino acids such as polyglutamic acid, polylysine, and the like; amino acid copolymers; inactivated virus particles; inactivated bacterial toxins such as toxoid from diphtheria, tetanus, cholera, leukotoxin molecules; liposomes; inactivated bacteria; dendritic cells; and the like. Carriers are described in further detail below.

Suitable carriers are well known in the art, and include, e.g., thyroglobulin, albumins such as human serum albumin, tetanus toxoid: Diphtheria toxoid; polyamino acids such as poly(D-lysine:D-glutamic acid); VP6 polypeptides of rotaviruses; influenza virus hemagglutinin, influenza virus nucleoprotein; hepatitis B virus core protein, hepatitis B virus surface antigen; purified protein derivative (PPD) of tuberculin from *Mycobacterium tuberculosis*; inactivated *Pseudomonas aeruginosa* exotoxin A (toxin A); Keyhole Limpet Hemocyanin (KLH); filamentous hemagglutinin (FHA) of *Bordetella perrussis*; T helper cell (Th) epitopes of tetanus toxoid (TT) and Bacillus Calmette-Guerin (BCG) cell wall; recombinant 10 kDa. 19 kDa and 30-32 kDa proteins from *M. leprae* or from *M. tuberculosis*, or any combination of these proteins; and the like. See, e.g., U.S. Pat. No. 6,447,778 for a discussion of carriers, and for methods of conjugating peptides to carriers.

*Pseudomonas aeruginosa* exotoxin A (toxin A) has been used effectively as a carrier in conjugate vaccines. *Pseudomonas aeruginosa* exotoxin A may be purified from the supernatant of fermentor-grown cultures of *Pseudomonas aeruginosa* PA 103. Toxin A has been classified as a superantigen based upon results in animals. Toxin A can be completely and irreversibly detoxified by covalent coupling to adipic acid dihydrazide (ADII), a 4 carbon spacer molecule. This step destroys the ADPR-transferase activity of the toxin molecule, hence rendering it nontoxic. The non-reacted hydrazide group can be used to covalently couple a polypeptide to toxin A. Toxin A may also be coupled to a polypeptide using a carbodiimide reagent.

PPD-peptide conjugates are conveniently prepared with glutaraldehyde as coupling agent. See. e.g., Rubinstein et al. (1995) *AIDS* 9:243-51.

The methods by which a subject polypeptide is conjugated with a carrier include disulfide linkages through a C terminal peptide cysteine linkage, coupling with glutaraldehyde solution for two hours, coupling with tyrosine, or coupling with water soluble carbodiimide.

In some embodiments, a subject target antigen is lipidated. Lipidation increases a cytotoxic T cell (CTL) response to the peptide that is linked to the lipid. The lipid residue, such as palmitic acid or the like, is attached to the amino terminus of the peptide. The lipid can be attached directly to the peptide, or, indirectly via a linkage, such as a Ser-Ser. Gly. Gly-Gly, Ser linkage or the like. As another example, *E. coli* lipoprotein, such as tripalmitoyl-S-glycerylcysteinyl-seryl-serine ($P_3$ CSS), can be used to prime specific CTL when covalently attached to the peptide. See, Deres et al., *Nature* 342:561-564 (1989). A subject target antigen can be conjugated with uncharged fatty acid residues of different chain lengths and degrees of unsaturation, ranging from acetic to stearic acid as well as to negatively charged succinyl residues via the appropriate carboxylic acid anhydrides. See, e.g., U.S. Pat. No. 6,419,931.

A subject target antigen may be conjugated directly or indirectly. e.g., via a linker molecule, to a carrier. A wide variety of linker molecules are known in the art and can be used in the conjugates. The linkage from the peptide to the carrier may be through a peptide reactive side chain, or the N- or C-terminus of the peptide. A linker may be an organic, inorganic, or semi-organic molecule, and may be a polymer of an organic molecule, an inorganic molecule, or a co-polymer comprising both inorganic and organic molecules.

If present, the linker molecules are generally of sufficient length to permit the subject target antigen and a linked carrier to allow some flexible movement between the subject target antigen and the carrier. The linker molecules are generally about 6-50 atoms long. The linker molecules may also be, for example, aryl acetylene, ethylene glycol oligomers containing 2-10 monomer units, diamines, diacids, amino acids, or combinations thereof. Other linker molecules which can hind to polypeptides may be used in light of this disclosure.

Compositions

The present disclosure provides compositions comprising a subject target antigen. Compositions comprising a subject target antigen can include one or more of: a salt, e.g., NaCl, $MgCl$, KCl, $MgSO_4$, etc.: a buffering agent, e.g., a Tris buffer, N-(2-Hydroxyethyl)piperazine-N'-(2-ethanesulfonic acid) (HEPES), 2-(N-Morpholino)ethanesulfonic acid (MES), 2-(N-Morpholino)ethanesulfonic acid sodium salt (MES), 3-(N-Morpholino)propanesulfonic acid (MOPS), N-tris[Hydroxymethyl]methyl-3-aminopropanesulfonic acid (TAPS), etc.; a solubilizing agent; a detergent, e.g., a non-ionic detergent such as Tween-20, etc.: a protease inhibitor; and the like. In some embodiments, as described in more detail below, a subject target antigen composition is an immunogenic composition. In other embodiments, as described in more detail below, a subject target antigen composition is a pharmaceutical composition, e.g., a composition comprising a subject target antigen and a pharmaceutically acceptable excipient.

Diagnostic Methods

The present disclosure provides methods of determining the likelihood that a patient who has been diagnosed with prostate cancer will exhibit a clinically beneficial response to treatment with an immunomodulatory treatment regimen. The methods generally involve determining an antibody response profile in the individual to one or more of the above-mentioned target antigens. As noted above, antibodies specific for one or more of the above-mentioned target antigens ("response indicator antigens"), where the antibodies are endogenous antibodies generated in an individual who has prostate cancer, and who exhibits a clinically beneficial response to treatment with an immunomodulatory treatment regimen, are referred to herein as "response indicator antibodies."

An antibody profile is detected in a biological sample (e.g., blood or a blood product such as serum, plasma, etc.), and the antibody profile either correlates directly with or is inversely correlated with, a clinically beneficial response to treatment with an immunomodulatory treatment regimen.

A level of an antibody, present in a biological sample from an individual who has prostate cancer and who has undergone treatment with an immunomodulatory treatment regimen for the prostate cancer, to one or more response indicator antigens, (a "response indicator antibody"), that is substantially higher than the level of the antibody in the individual before treatment with the immunomodulatory treatment regimen, indicates an increased likelihood that the individual will exhibit a clinically beneficial response to treatment with the immunomodulatory treatment regimen.

For example, the level in an individual, who has prostate cancer and who has been treated with an immunomodulatory treatment regimen, of a response indicator antibody that is at least about 25%, at least about 50%, at least about 75%, at least about 100% (or two-fold), at least about 2.5-fold, at least about 5-fold, at least about 10-fold, at least about 25-fold, at least about 50-fold, or at least about 100-fold higher than a control level of the antibody (e.g., the level of the antibody in the individual before treatment with the immunomodulatory treatment regimen), indicates an increased likelihood that the individual will exhibit a clinically beneficial response to treatment with the immunomodulatory treatment regimen.

For example, the level in an individual, who has prostate cancer and who has been treated with an immunomodulatory treatment regimen, of a response indicator antibody that is at least about 25%, at least about 50%, at least about 75%, at least about 100% (or two-fold), at least about 2.5-fold, at least about 5-fold, at least about 10-fold, at least about 25-fold, at least about 50-fold, or at least about 100-fold higher than a control level (e.g., the level of the antibody in the individual before treatment with the immunomodulatory treatment regimen), indicates an at least about 10%, at least about 20%, at least about 25%, at least about 30%, at least about 40%, at least about 50%, at least about 60%, at least about 70%, at least about 80%, or greater than 80%, increased likelihood that the individual will exhibit a clinically beneficial response to treatment with the immunomodulatory treatment regimen.

A level of an antibody, present in a biological sample from an individual who has prostate cancer, to one or more response indicator antigens, that is substantially higher than a non-responder control level, indicates an increased likelihood that the individual will exhibit a clinically beneficial response to treatment with an immunomodulatory treatment regimen.

For example, the level in an individual who has prostate cancer (and who has not yet been treated for the prostate cancer) of a response indicator antibody that is at least about 25%, at least about 50%, at least about 75%, at least about 100% (or two-fold), at least about 2.5-fold, at least about 5-fold, at least about 10-fold, at least about 25-fold, at least about 50-fold, or at least about 100-fold higher than a non-responder control level, indicates an increased likelihood that the individual will exhibit a clinically beneficial response to treatment with an immunomodulatory treatment regimen.

For example, the level in an individual who has prostate cancer (and who has not yet been treated for the prostate cancer) of a response indicator antibody that is at least about 25%, at least about 50%, at least about 75%, at least about 100% (or two-fold), at least about 2.5-fold, at least about 5-fold, at least about 10-fold, at least about 25-fold, at least about 50-fold, or at least about 100-fold higher than a non-responder control level indicates an at least about 10%, at least about 20%, at least about 25%, at least about 30%, at least about 35%, at least about 40%, at least about 45%, at least about 50%, at least about 60%, at least about 70%, at least about 80%, or greater than 80%, increased likelihood that the individual will exhibit a clinically beneficial response to treatment with an immunomodulatory treatment regimen.

A non-responder control level of an antibody can be readily determined by determining the level of a response indicator antibody in a statistically significant number of individuals who have prostate cancer and who did not exhibit a clinically beneficial response to an immunomodulatory treatment regimen. A non-responder control level is a range of level of a response indicator antibody detected in a statistically significant number of individuals who have prostate cancer and who did not exhibit a clinically beneficial response to an immununomodulatory treatment regimen.

In some embodiments, the level of response indicator antibody to two or more prostate cancer-associated target antigens is determined. For example, in some embodiments, the level of response indicator antibody to 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, from about 42 to about 45, from about 45 to about 50, from about 50 to about 60, from about 60 to about 70, or from about 70 to about 82 of the antigens listed in Table 1 is determined. Where the level of response indicator antibody to two or more prostate cancer-associated target antigens is determined, the two or more antibody levels are collectively referred to as an "antibody profile."

In some embodiments, the level of a response indicator antibody is expressed as a "normalized level." For example, either Quantile Normalization or Robust Linear Normalization can be utilized to obtain a "normalized level". In one embodiment, Quantile Normalization is utilized to obtain a normalized response level. In the context of protein arrays, this method forces the arrays to have identical intensity distribution to allow comparison between arrays that may have systematic measurement errors.

In another embodiment. Robust Linear Normalization is utilized to obtain a normalized response level. This method uses a statistical linear model and positive control proteins, e.g., IgG and V5 to lit the model and also removes systematic measurement errors.

A level in an individual, who has prostate cancer and who has been treated with an immunomodulatory treatment regimen, of a response indicator antibody(ies) that is at least about 25%, at least about 50%, at least about 75%, at least about 100% (or two-fold), at least about 2.5-fold, at least about 5-fold, at least about 10-fold, at least about 25-told, at least about 50-fold, or at least about 100-fold higher than the level of the antibody in the individual before treatment with the immunomodulatory treatment regimen, indicates that the individual has an increased likelihood of exhibiting a clinically beneficial response to treatment with the immunomodulatory treatment regimen. In other words, a level in an individual, who has prostate cancer and who has been treated with an immunomodulatory treatment regimen, of a response indicator antibody(ies) that is at least about 25%, at least about 50%, at least about 75%, at least about 100% (or two-fold), at least about 2.5-fold, at least about 5-fold, at least about 10-fold, at least about 25-fold, at least about 50-fold, or at least about 100-fold higher than the level of the antibody in the individual before treatment with the immunomodulatory treatment regimen, indicates that the individual has an at least about 10%, at least about 15%, at least about 20%, at least about 25%, at least about 30%, at least about 40%, at least about 50%, at least about 60%, at least about 70%, at least about 80%, or greater than 80%, increased likelihood of exhibiting a clinically beneficial response to treatment with the immunomodulatory treatment regimen, compared to an individual who does not exhibit an increased level of the response indicator antibody(ies).

A level in an individual, who has prostate cancer and who has not yet been treated for the prostate cancer, of a response indicator antibody(ies) that is at least about 25%, at least about 50%, at least about 75%, at least about 100% (or two-fold), at least about 2.5-fold, at least about 5-fold, at least about 10-fold, at least about 25-fold, at least about 50-fold, or at least about 100-fold higher than a non-responder control level of the antibody, indicates that the individual has an increased likelihood of exhibiting a clinically beneficial response to treatment with an immunomodulatory treatment regimen. In other words, a level in an individual, who has prostate cancer and who has not yet been treated for the prostate cancer, of a response indicator antibody(ies) that is at least about 25%, at least about 50%, at least about 75%, at least about 100% (or two-fold), at least about 2.5-fold, at least about 5-fold, at least about 10-fold, at least about 25-fold, at least about 50-fold, or at least about 100-fold higher than a non-responder control level of the antibody, indicates that the individual has an at least about 10%, at least about 15%, at least about 20%, at least about 25%, at least about 30%, at least about 40%, at least about 50%, at least about 60%, at least about 70%, at least about 80%, or greater than 80%, increased likelihood of exhibiting a clinically beneficial response to treatment with an immunomodulatory treatment regimen, compared to the likelihood of a non-responder control.

The level of an antibody to a target antigen can be determined using any of a number of immunological assays. For example, a detectably labeled subject target antigen, or a panel of detectably labeled target antigens, can be employed, where the level of signal produced in an immunological assay is proportional to the amount of antibody in a biological sample. Suitable assays include. e.g., enzyme-linked immunosorbent assays (ELISA), radioimmunoassay (RIA), and the like.

In some embodiments, the assay is a sandwich assay, in which an antibody specific for the Fe portion of human antibody is immobilized on an insoluble support; a biological sample from a test individual (e.g., an individual having prostate cancer; an individual having prostate cancer who has been treated with an immunomodulatory treatment regimen, an individual having prostate cancer who has not yet been treated for the cancer) is contacted with the immobilized antibody, forming a complex between antibodies present in the biological sample and the immobilized antibody; and the complex is contacted with a subject detectably labeled prostate cancer-associated antigen. The level of signal produced by the detectably labeled prostate cancer-associated antigen indicates the level of antibody in the biological sample that is specific for a subject prostate cancer-associated antigen. Suitable insoluble support materials include. e.g., agarose, sepharose, nitrocellulose, silica, polystyrene, and the like. The insoluble support can be in any of a variety of forms, including, e.g., heads, magnetic beads, films, strips, chips, multi-well plates, and the like.

Immunogenic Compositions

The present disclosure provides an immunogenic composition comprising a subject target antigen. A subject immunogenic composition is useful for inducing in an individual an immune response to a subject target antigen.

In some embodiments, a subject immunogenic composition comprises a subject target antigen, and an adjuvant. Suitable adjuvants include those suitable for use in humans. Examples of known suitable adjuvants that can be used in humans include, but are not necessarily limited to, alum, aluminum phosphate, aluminum hydroxide. MF59 (4.3% w/v squalenc, 0.5% w/v polysorbate 80 (Tween 80), 0.5% w/v sorbitan trioleate (Span 85)), a CpG-containing nucleic acid (where the cytosine is unmethylated). QS21 (saponin adjuvant), MPL (Monophosphoryl Lipid A), 3DMPL (3-O-deacylated MPL), extracts from Aquilla. ISCOMS (see, e.g., Sjölander et al. (1998) *J. Leukocyte Biol.* 64:713), LT/CT mutants, poly(D,L-lactide-co-glycolide) (PLG) microparticles, Quil A, interleukins, and the like. For veterinary applications including but not limited to animal experimentation, one can use Freund's, N-acetyl-muramyl-L-threonyl-D-isoglutamine (thr-MDP), N-acetyl-nor-muramyl-L-alanyl-D-isoglutamine (CGP 11637, referred to as nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (CGP 19835A, referred to as MTP-PE), and RIBI, which contains three components extracted from bacteria, monophosphoryl lipid A, trehalose dimycolate and cell wall skeleton (MPL+TDM+CWS) in a 2% squalene/ Tween 80 emulsion.

Further exemplary adjuvants to enhance effectiveness of the composition include, but are not limited to: (1) oil-in-water emulsion formulations (with or without other specific immunostimulating agents such as muramyl peptides (see below) or bacterial cell wall components), such as for example (a) MF59™ (WO90/14837; Chapter 10 in *Vaccine design: the subunit and adjuvant approach*, eds. Powell & Newman. Plenum Press 1995), containing 5% Squalene, 0.5% Tween 80 (polyoxyethylene sorbitan mono-oleate), and 0.5% Span 85 (sorbitan trioleate) (optionally containing muramyl tri-peptide covalently linked to dipalmitoyl phosphatidylethanolamine (MTP-PE)) formulated into submicron particles using a microfluidizer, (b) SAF, containing 10% Squalane, 0.4% Tween 80, 5% pluronic-blocked polymer L121, and thr-MDP either microfluidized into a submicron emulsion or vortexed to generate a larger particle size emulsion, and (c) RIBI™ adjuvant system (RAS), (Ribi Immunochem, Hamilton, Mont.) containing 2% Squalene, 0.2% Tween 80, and one or more bacterial cell wall components such as monophosphorylipid A (MPL), trehalose dimycolate (TDM), and cell wall skeleton (CWS), e.g., MPL+CWS (DETOX™); (2) saponin adjuvants, such as QS21 or STIMULON™ (Cambridge Bioscience, Worcester, Mass.) may be used or particles generated therefrom such as ISCOMs (immunostimulating complexes), which ISCOMS may be devoid of additional detergent e.g. WO 00/07621; (3) Complete Freund's Adjuvant (CFA) and Incomplete Freund's Adjuvant (IFA); (4) cytokines, such as interleukins (e.g. IL-1, IL-2, IL-4, IL-5, IL-6, IL-7, IL-12 (WO99/44636), etc.), interferons (e.g. gamma interferon), macrophage colony stimulating factor (M-CSF), tumor necrosis factor (TNF), other TNF superfamily molecules (e.g., CH40L, OX40L, and the like), etc.; (5) monophosphoryl lipid A (MPL) or 3-O-deacylated MPL (3dMPL) e.g. GB-2220221. EP-A-0689454, optionally in the substantial absence of alum when used with pneumococcal saccharides e.g. WO00/56358; (6) combinations of 3dMPL with, for example, QS21 and/or oil-in-water emulsions e.g. EP-A-0835318. EP-A-0735898. EP-A-0761231; (7) oligonucleotides comprising CpG motifs [Krieg Vaccine 2000, 19, 618-622; Krieg Curr Opin Mol Ther 2001 3:15-24; Roman et al., Nat. Med., 1997, 3, 849-854; Weiner et al., PNAS USA, 1997, 94, 10833-10837; Davis et al, J. Immunol, 1998, 160, 870-876; Chu et al., J. Exp. Med, 1997, 186, 1623-1631; Lipford et al, Eur. J. Immunol, 1997, 27, 2340-2344; Moldoveanu et al., Vaccine. 1988, 16, 1216-1224. Krieg et al., Nature. 1995, 374, 546-549; Klinman et al., PNAS USA, 1996, 93, 2879-2883; Ballas et al, J. Immunol. 1996, 157, 1840-1845; Cowdery et al. J. Immunol. 1996, 156, 4570-4575; Halpern et al, Cell Immunol, 1996, 167, 72-78; Yamamoto et al. Jpn. J. Cancer Res., 1988, 79, 866-873: Stacey et al. J. Immunol., 1996, 157, 2116-2122; Messina et al, J. Immunol, 1991, 147, 1759-1764; Yi et al, J. Immunol. 1996, 157, 4918-4925; Yi et al, J. Immunol. 1996, 157, 5394-5402; Yi et al, J. Immunol, 1998, 160, 4755-4761; and Yi et al. J. Immunol, 1998, 160, 5898-5906; International patent applications WO96/02555, WO98/16247, WO98/18810, WO98/40100, WO98/55495. WO98/37919 and WO98/52581]i.e. containing at least one CG dinucleotide, where the cytosine is unmethylated; (8) a polyoxyethylene ether or a polyoxyethylene ester e.g. WO99/52549; (9) a polyoxyethylene sorbitan ester surfactant in combination with an octoxynol (WO01/21207) or a polyoxyethylene alkyl ether or ester surfactant in combination with at least one additional non-ionic surfactant such as an octoxynol (WO01/21152); (10) a saponin and an immunostimulatory oligonucleotide (e.g. a CpG oligonucleotide) (WO0/62800); (11) an immunostimulant and a particle of metal salt e.g. WO00/23105; (12) a saponin and an oil-in-water emulsion e.g. WO99/1241; (13) a saponin (e.g. QS21)+3dMPL+IM2 (optionally+a sterol) e.g. WO98/57659; (14) other substances that act as immunostimulating agents to enhance the efficacy of the composition. Muramyl peptides include N-acetyl-muramyl-L-threonyl-D-isoglutamine (thr-MDP), N-25 acetyl-nornmuramyl-L-alanyl-D-isoglutanmine (nor-MDP), N-acetylmuramyl-L-alanyl-D-isoglutarninyl-L-alanine-2-(1'-2'-dipalmitoyl-sn-glycero-3-hydroxyphosphoryloxy)-ethylamine MTP-PE), etc.

A subject immunogenic composition can include a conventional pharmaceutically acceptable excipient, such as pharmaceutical grades of mannitol, lactose, starch, magnesium stearate, sodium saccharin, talcum, cellulose, glucose, sucrose, magnesium, carbonate, and the like. A subject immunogenic composition can include one or more pharmaceutically acceptable auxiliary substances as required to approximate physiological conditions such as pH adjusting and buffering agents, toxicity adjusting agents and the like, for example, sodium acetate, sodium chloride, potassium chloride, calcium chloride, sodium lactate and the like. The concentration of antigen (e.g., a subject target antigen) in these formulations can vary widely, and can be selected based on various factors such as fluid volumes, viscosities, body weight and the like in accordance with the particular mode of administration selected and the patient's needs. The resulting compositions may be in the form of a solution, suspension, tablet, pill, capsule, powder, gel, cream, lotion, ointment, aerosol or the like.

The protein concentration of a subject immunogenic composition in the pharmaceutical formulations can vary widely, e.g., less than about 0.1%, from about 0.1% to about 2%, from about 2% to 20%, or from about 20% to about 50%, or more, by weight, and will be selected on the basis of various factors such as fluid volumes, viscosities, etc., in accordance with the particular mode of administration selected.

Methods of Inducing an Immune Response

The present disclosure provides a method of inducing an immune response in an individual to a target antigen associated with prostate cancer. The methods generally involve administering to an individual having prostate cancer a subject prostate cancer-associated target antigen in an amount effective to induce an immune response to the target antigen. Suitable immune responses include. e.g., an antibody response, a $CD4^+$ T cell response, and a cytotoxic T cell (CTL) response. In some embodiments, a subject method of inducing an immune response in an individual to a prostate cancer-associate target antigen involves administering to the individual an effective amount of a subject immunogenic composition (e.g., a composition comprising a subject prostate cancer-associated target antigen and an adjuvant).

In some embodiments, a subject method of inducing an immune response in an individual increases the likelihood that the individual will respond to treatment for prostate cancer with an immunomodulatory treatment regimen.

A subject prostate cancer-associated target antigen, or a subject immunogenic composition comprising a subject prostate cancer-associated target antigen, is administered to an individual in one or more doses. Suitable amounts of a subject prostate cancer-associated target antigen per dose range from about 100 µg to about 100 mg, e.g., from about 100 µg to about 250 µg, from about 250 µg to about 500 g, from about 500 µg to about 1 mg, from about 1 mg to about 10 mg, from about 10 mg to about 25 mg, from about 25 mg to about 50 mg, from about 50 mg to about 75 mg, or from about 75 mg to about 100 mg.

Antibodies Specific for Target Antigens

The present disclosure provides antibodies specific for a subject prostate cancer-associated target antigen. In certain embodiments, a subject prostate cancer-associated target antigen-specific antibody is isolated, e.g., is in an environment other than its naturally-occurring environment. Suitable antibodies specific for a subject prostate cancer-associated target antigen include antibodies of any isotype; single-chain Fv; Fab; Fab; Fv; F(ab')$_2$; artificial antibodies; humanized antibodies; and the like. In some embodiments, a subject antibody is specific for a mutant prostate-associated target antigen.

Suitable antibodies are obtained by immunizing a host animal with peptides comprising all or a portion of a subject prostate cancer-associated target antigen. Suitable host animals include mouse, rat sheep, goat, hamster, rabbit, etc. The host animal will generally be from a different species than the immunogen where the immunogen is from a naturally occurring source, e.g., a human sample, where representative host animals include, but are not limited to, e.g., rabbits, goats, mice, etc.

The immunogen may comprise the complete protein, or fragments and derivatives thereof. Generally, immunogens comprise all or a part of the protein, where these residues contain any post-translation modifications found on the native target protein. Immunogens are produced in a variety of ways known in the art, e.g., expression of cloned genes using conventional recombinant methods, preparation of fragments of a subject deacylase protein using well-known methods, etc.

For preparation of polyclonal antibodies, the first step is immunization of the host animal with the target protein, where the target protein can be in substantially pure form, comprising less than about 1% contaminant. The immunogen may comprise the complete prostate cancer-associated target antigen protein, fragments or derivatives thereof. To increase the immune response of the host animal, the prostate cancer-associated target antigen protein may be combined with an adjuvant, where suitable adjuvants include alum, dextran, sulfate, large polymeric anions, and oil-and-water emulsions, e.g. Freund's adjuvant, Freund's complete adjuvant, and the like. A subject prostate cancer-associated target antigen protein may also be conjugated to synthetic carrier proteins or synthetic antigens. A variety of hosts may be immunized to produce polyclonal antibodies. Such hosts include rabbits, guinea pigs, rodents, e.g. mice, rats, sheep, goats, and the like. A subject prostate cancer-associated target antigen protein is administered to the host. e.g., intradermally or intramuscularly, with an initial dosage followed by one or more, usually at least two, additional booster dosages. Following immunization, the blood from the host will be collected, followed by separation of the serum from the blood cells. The Ig present in the resultant antiserum may be further fractionated using known methods, such as ammonium salt fractionation, DEAE chromatography, and the like.

Monoclonal antibodies are produced by conventional techniques. Generally, the spleen and/or lymph nodes of an immunized host animal provide a source of plasma cells. The plasma cells are immortalized by fusion with myeloma cells to produce hybridoma cells. Culture supernatant from individual hybridomas is screened using standard techniques to identify those producing antibodies with the desired specificity. Suitable animals for production of monoclonal antibodies include mouse, rat, hamster, guinea pig, rabbit, etc. The antibody may be purified from the hybridoma cell supernatants or ascites fluid by conventional techniques, e.g. affinity chromatography using protein bound to an insoluble support, protein A sepharose, etc.

The antibody may be produced as a single chain, instead of the normal multimeric structure. Single chain antibodies are described in Jost et al. (1994) J. B. C. 269:26267-73, and others. DNA sequences encoding the variable region of the heavy chain and the variable region of the light chain are ligated to a spacer encoding at least about 4 amino acids of small neutral amino acids, including glycine and/or serine. The protein encoded by this fusion allows assembly of a functional variable region that retains the specificity and affinity of the original antibody.

Antibodies specific for a subject prostate cancer-associated target antigen also include "artificial" antibodies. e.g., antibodies and antibody fragments produced and selected in vitro. In some embodiments, such antibodies are displayed on the surface of a bacteriophage or other viral particle. In many embodiments, such artificial antibodies are present as fusion proteins with a viral or bacteriophage structural protein, including, but not limited to, M13 gene III protein. Methods of producing such artificial antibodies are well known in the art. See, e.g., U.S. Pat. Nos. 5,516,637; 5,223,409; 5,658,727; 5,667,988; 5,498,538; 5,403,484; 5,571,698; and 5,625,033.

Antibody fragments, such as Fv, F(ab')$_2$ and Fab may be prepared by cleavage of the intact protein, e.g. by protease or chemical cleavage. Alternatively, a truncated gene is designed. For example, a chimeric gene encoding a portion of the F(ab')$_2$ fragment would include DNA sequences encoding the CH1 domain and hinge region of the H chain, followed by a translational stop codon to yield the truncated molecule.

Expression vectors include plasmids, retroviruses, YACs, EBV derived episomes, and the like. A convenient vector is one that encodes a functionally complete human CH or CL immunoglobulin sequence, with appropriate restriction sites engineered so that any VH or VL sequence can be easily inserted and expressed. In such vectors, splicing usually occurs between the splice donor site in the inserted J region and the splice acceptor site preceding the human C region, and also at the splice regions that occur within the human CH exons. Polyadenylation and transcription termination occur at native chromosomal sites downstream of the coding regions. The resulting chimeric antibody may be joined to any strong promoter, including retroviral LTRs. e.g. SV-40 early promoter, (Okayama et al. (1983) Mol. Cell. Bio. 3:280). Rous sarcoma virus LTR (Gorman et al. (1982) P.N.A.S. 79:6777), and moloney murine leukemia virus LTR (Grosschedl al. (1985) Cell 41:885); native Ig promoters, etc.

A subject antibody specific for a subject prostate cancer-associated target antigen will in some embodiments be detectably labeled, e.g., with a radioisotope, an enzyme which generates a detectable product, a fluorescent protein, a chromogenic protein, and the like. An antibody specific for a subject prostate cancer-associated target antigen may be further conjugated to other moieties, such as members of specific binding pairs. e.g., biotin (member of biotin-avidin specific binding pair), and the like. An antibody specific for a subject prostate cancer-associated target antigen may also be bound to a solid support, including, but not limited to, polystyrene plates or beads, magnetic beads, test strips, membranes, and the like.

In some embodiments, an antibody specific for a subject prostate cancer-associated target antigen is detectably labeled, either directly or indirectly. Direct labels include radioisotopes (e.g., $^{125}$I; $^{35}$S, and the like); enzymes whose products are detectable (e.g., luciferase, β-galactosidase, horse radish peroxidase, alkaline phosphatase, and the like); fluorescent labels (e.g., fluorescein isothiocyanate, rhodamine, phycoerythrin, and the like); fluorescence emitting metals. e.g., $^{152}$Eu, or others of the lanthanide series, attached to the antibody through metal chelating groups such as EDTA; chemiluminescent compounds, e.g., luminol, isoluminol, acridinium salts, and the like; bioluminescent compounds, e.g., luciferin; fluorescent proteins; and the like. Indirect labels include second antibodies specific for a subject antibody, wherein the second antibody is labeled as described above; and members of specific binding pairs, e.g., biotin-avidin, and the like.

In some embodiments, a subject antibody comprises, covalently linked to the antibody, a protein that provides for a detectable signal. Suitable proteins include, but are not limited to, fluorescent proteins and enzymes (e.g., f-galactosidase, luciferase, horse radish peroxidase, alkaline phosphatase, etc.). Suitable fluorescent proteins include, but are not limited to, a green fluorescent protein (GFP), including, but not limited to, a GFP derived from *Aequoria victoria* or a derivative thereof, a number of which are commercially available; a GFP from a species such as *Renilla reniformis*, *Renilla mulleri*, or *Ptilosarcus guernyi*, as described in. e.g., WO 99/49019 and Peelle et al. (2001) *J. Protein Chem.* 20:507-519; any of a variety of fluorescent and colored proteins from Anthozoan species, as described in, e.g., Matz et al. (1999) *Nature Biotechnol.* 17:969-973, U.S. Patent Publication No. 2002/0197676, or U.S. Patent Publication No. 2005/0032085; a yellow fluorescent protein; a blue fluorescent protein; and the like.

A subject antibody can be coupled to one or more of a therapeutic drug; a compound emitting radiation; a molecule of plants, fungal, or bacterial origin; and a biological protein. The cytotoxic drugs can be intracellularly acting cytotoxic drugs, such as short-range radiation emitters, including, for example, short-range, high-energy α-emitters.

Enzymatically active toxins and fragments thereof are exemplified by diphtheria toxin A fragment, nonbinding active fragments of diphtheria toxin, exotoxin A (from *Pseudomonas aeruginosa*), ricin A chain, abrin A chain, modeccin A chain, α-sacrin, certain *Aleurites fordii* proteins, certain Dianthin proteins. *Phytolacca americana* proteins (PAP. PAPII and PAP-S), *Morodica charantia* inhibitor, curcin, crolin, *Saponaria officinalis* inhibitor, gelonin, mitogillin, restrictocin, phenomycin, and enomycin, for example. Procedures for preparing active polypeptides of the immunotoxins are described in WO84/03508 and WO85/03508. Certain cytotoxic moieties are derived from adriamycin, chlorambucil, daunomycin, methotrexate, neocarzinostatin, and platinum, for example.

Methods of Treating Prostate Cancer

The present disclosure provides methods of treating prostate cancer in an individual having prostate cancer, the methods generally involving administering to the individual an effective amount of a subject antibody, i.e., an antibody specific for a prostate cancer-associated target antigen.

In some embodiments, an effective amount of a subject antibody is an amount that is effective, when administered in one or more doses, to reduce the number of prostate cancer cells in an individual by at least about 10%, at least about 20%, at least about 25%, at least about 30%, at least about 40%, at least about 50%, at least about 60%, at least about 70%, at least about 80%, or more than 80%, compared to the number of prostate cancer cells in the untreated individual.

For therapeutic applications, a subject antibody can be administered to a mammal, e.g., a human (e.g., a male having prostate cancer), in a pharmaceutically acceptable dosage form, including those that may be administered to a human intravenously as a bolus or by continuous infusion over a period of time, by intramuscular, subcutaneous, intra-articular, intrasynovial, intrathecal, oral, topical, or inhalation routes. A subject antibody is also suitably administered by intratumoral, peritumoral, intralesional, or perilesional routes, to exert local as well as systemic therapeutic effects.

Such dosage forms encompass pharmaceutically acceptable carriers that are inherently nontoxic and nontherapeutic. Examples of such carriers include ion exchangers, alumina, aluminum stearate, lecithin, serum proteins, such as human serum albumin, buffer substances such as phosphates, glycine, sorbic acid, potassium sorbate, partial glyceride-mixtures of saturated vegetable fatty acids, water, salts, or electrolytes such as protamine sulfate, disodium hydrogen phosphate, potassium hydrogen phosphate, sodium chloride, zinc salts, colloidal silica, magnesium trisilicate, polyvinyl pyrrolidone, cellulose-based substances, and polyethylene glycol. Carriers for topical or gel-based forms of antibody include polysaccharides such as sodium carboxymethylcellulose or methylcellulose, polyvinylpyrrolidone, polyacrylates, polyoxyethylene-polyoxypropylene-block polymers, polyethylene glycol, and wood wax alcohols. For all administrations, conventional depot forms are suitably used. Such forms include, for example, microcapsules, nano-capsules, liposomes, plasters, inhalation forms, nose sprays, and sublingual tablets. The antibody will typically be formulated in such vehicles at a concentration of about 0.1 mg/nil to 100 mg/ml.

For the prevention or treatment of prostate cancer, the appropriate dosage of antibody will depend on the type of disease to be treated, as defined above, the severity and course of the disease, whether the antibodies are administered for preventive or therapeutic purposes, previous therapy, the patient's clinical history and response to the antibody, and the discretion of the attending physician. The antibody is suitably administered to the patient at one time or over a series of treatments.

Depending on the type and severity of the disease, about 0.015 to 15 mg/kg of antibody is an initial candidate dosage for administration to the patient, whether, for example, by one or more separate administrations, or by continuous infusion. For repeated administrations over several days or longer, depending on the condition, the treatment is repeated until a desired suppression of disease symptoms occurs. However, other dosage regimens may be useful.

According to another embodiment of the invention, the effectiveness of the antibody in preventing or treating disease may be improved by administering the antibody serially or in combination with another agent that is effective for those purposes, such as another antibody directed against a different epitope or neutralizing a different protein than the first antibody, or one or more conventional therapeutic agents such as, for example, anti-cancer chemotherapeutic agents. Such other agents may be present in the composition being administered or may be administered separately. Also, the antibody is suitably administered serially or in combination with radiological treatments, whether involving irradiation or administration of radioactive substances.

A subject antibody can be used in conjunction with other therapeutic treatment modalities. Such other treatments include surgery, radiation, cryosurgery, thermotherapy, hormone treatment, chemotherapy, vaccines, and other immunotherapies.

Treatment in accordance with the present disclosure can be effectively monitored with clinical parameters such as serum prostate specific antigen and/or pathological features of a patient's cancer, including stage, Gleason score, extracapsular, seminal, vesicle or perineural invasion, positive margins, involved lymph nodes, etc. Alternatively, these parameters can be used to indicate when such treatment should be employed.

Target Antigens in Autoimmune Disorders

The present disclosure relates to the observation that individuals affected with autoimmune disorders (e.g., systemic lupus erythematosus (SLE) and type 1 diabetes mellitus) can mount an immune response to one or more self-antigens.

SLE-Associated Self-Antigens

Self-antigens that are the target of an immune response generated in an individual who has SLE (referred to herein as "SLE-associated self antigens") include, but are not limited to, those shown in Table 2, below.

TABLE 2

| Name | GenBank Accession No. | Name | GenBank Accession No. |
|---|---|---|---|
| MAPK9 (JNK2) | NM_002752 | CTNNA1 | BC031262 |
| ATF2 | BC026175 | MAPRE1 | NM_012325 |
| ITGA6 | NM_000210 | NIP30 | NM_024946 |
| PIP5K2C | NM_024779 | LRRC6 | NM_012472 |
| ZAP-70 | NM_001079 | PAK1 | NM_002576 |
| NOLC1 | BC006769 | C10orf91 | NM_173541 |
| SH3GL2 | BC032825 | STK25 | NM_006374 |
| RPAP3 | BC056415 | C7orf50 | NM_032350 |
| NECAB3 | BC047673 | ABL2 | NM_005158 |
| ISG20 | NM_002201 | RAD51AP1 | NM_006479 |
| C19orf33 | BC060319 | CCDC55 | NM_032141 |
| TRIM21 | NM_003141 | IRS1 | BC053895 |
| SMCR7 | NM_139162 | PDGFRB | NM_002609 |
| SNRPA | NM_004596 | RBPJ | NM_203284 |
| RPLP2 | NM_001004 | STAC | BC020221 |
| CASZ1 | BC004410 | MPG | BC014991 |
| SNRP70 | NM_003089 | SF3B4 | NM_005850 |
| SNRPC | NM_003093 | FGFR3 | NM_000142 |
| FGF12 | NM_004113 | ASPSCR1 | BC018722 |
| CAMK2N1 | NM_018584 | WIBG | NM_032345 |
| IFI6 | BC024289 | C3orf37 | BC009993 |
| KIAA0515 | BC012289 | IRAK4 | NM_016123.1 |
| LOC400027 | XM_378350.2; BC047417 | | |

The present disclosure provides an isolated target antigen wherein the isolated target antigen comprises an amino acid sequence that is substantially similar to an antigenic sequence of an SLE-associated self-antigen. The present disclosure also provides antigenic fragments and variants of SLE-associated self antigens. In some embodiments, a subject isolated target antigen is synthetic, e.g., a subject synthetic target antigen is synthesized chemically in a laboratory.

A subject isolated target antigen can be from 6 amino acids in length up to the length of a naturally-occurring SLE-associated self-antigen, e.g., a subject isolated target antigen can be 6 amino acids (aa), 7 aa, 8 aa, 9 aa, 10 aa, 11 aa, 12-15 aa, 15-20 aa, 20-25 aa, 25-30 aa, 30-40 aa, 40-50 aa, 50-100 aa, or longer than 100 amino acids. e.g., 100 aa to 150 aa, or 150 aa to 200 aa. In some embodiments, a subject isolated target antigen has a length of from about 6 aa to about 150 aa. e.g., from about 6 aa to about 10 aa, from about 10 aa to about 15 aa, from about 15 aa to about 20 aa, from about 20 aa to about 25 aa, from about 25 aa to about 30 aa, from about 30 aa to about 40 aa, from about 40 aa to about 50 aa, from about 50 aa to about 75 aa, from about 75 aa to about 100 aa, from about 100 aa to about 125 aa, or from about 125 aa to about 150 aa.

In some embodiments, a subject isolated target antigen comprises from about 6, 7, 8, 9, 10, 11, 12, 13-15, 15-17, 17-20, from 20 to 25, from 25 to 50, from 50 to 75, from 75 to 100, or from 100 to 150, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in one of the following GenBank Accession Numbers: NM_002752, BC026175, NM_000210, NM_024779, NM_001079, BC006769, BC032825, BC056415, BC047673, NM_00220, BC060319, NM_003141 NM_139162, NM_004596, NM_001004, BC004410, NM_003089, NM_003093, NM_004113, NM_018584, BC024289, BC012289, BC031262, NM_012325, NM_024946, NM_012472, NM_002576, NM_173541, NM_006374, NM_032350, NM_005158, NM_006479, NM_032141, BC053895, NM_002609, NM_203284, BC020221, BC014991, NM_005850, NM_000142, BC018722, NM_032345, BC009993, NM_016123.1, or XM_378350.2 (BC047417).

In some embodiments, a subject target antigen comprises from about 6, 7, 8, 9, 10, 11, 12, 13-15, 15-17, 17-20, from 20 to 25, from 25 to 50, from 50 to 75, from 75 to 100, or from 100 to 150, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in one of SEQ ID NOs:43-85, 148, and 149.

In some embodiments, a subject target antigen comprises from about 6, 7, 8, 9, 10, 11, 12, 13-15, 15-17, 17-20, from 20 to 25, from 25 to 50, from 50 to 75, from 75 to 100, or from 100 to 150, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in one of SEQ ID NOs:43-85; and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 41) aa, from 40 aa to 50 aa, from 50 aa to 100 aa, from 100 aa to 150 aa, or from 150 aa to 200 aa.

In some embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in one of SEQ ID NO:s 43-85, 148, and 149.

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150 from 150 to 200, from 200 to 300, or from 300 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:43 (NM_002752; MAPK9 (JNK2)).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150 from 150 to 200, from 200 to 300, or from 300 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:43 (NM_002752); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, or from 400 aa to 424 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:43 (NM_002752).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, or from 150 to 200, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:44 (BC026175; ATF2).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, or from 150 to 200, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:44 (BC026175); and has a length of 6 amino acids (aa), 7 aa, 8 aa, 9 aa, 10 aa, 11 aa, from 12 an to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, or from 200 aa to 209 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:44 (BC026175).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 500, or from 500 to 1000, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:45 (NM_000210; ITGA6; integrin-α6).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 500, or from 500 to 1000, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:45 (NM_000210); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 an to 40 aa, from 40 aa to 50 aa, from 50 aa to 100 aa, from 100 aa to 150 aa, from 150 aa to 200 aa, from 200 aa to 500 aa, from 500 aa to 1000 aa, or from 1000) a to 1073 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:45 (NM_000210).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 400, or more, contiguous amino acids (an) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:46 (NM 024779; phosphatidylinositol-5-phosphate 4-kinase, type II, gamma; PIP5K2C).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:46 (NM_024779); and has a length of 6 amino acids (aa), 7 aa, 8 aa, 9 aa, 10 aa, 11 aa, from 12 an to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 400 aa, or from 400 aa to 421 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:46 (NM_024779).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 400, from 400 to 600, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:47 (NM_001079; zeta-chain (TCR) associated protein kinase 70 kDa; ZAP-70).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 400, from 400 to 600, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:47 (NM_001079); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 400 aa, from 400 aa to 600 aa, or from 600 aa to 619 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100%, amino acid sequence identity to the amino acid sequence set forth in SEQ ID NO:47 (NM_001079).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:48 (BC006769; nucleolar and coiled-body phosphoprotein 1; NOLC1).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:48 (BC006769); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 as, from 100 aa to 150 aa, from 150 aa to 200 aa, from 200 aa to 400 aa, or from 400 aa to 418 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:48 (BC006769).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 250, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:49 (BC032825; SH3-domain GRB2-like 2; SH3GL2).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 250, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:49 (BC032825); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 as, from 100 aa to 150 aa, from 150 aa to 200 aa, from 200 aa to 250 aa, or from 250 aa to 279 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:49 (BC032825).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 400, from 400 to 600, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:50 (BC056415; RNA polymerase II associated protein 3; RPAP3).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 400, from 400 to 600, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:50 (BC056415); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 400 aa, from 400 aa to 600 aa, or from 600 aa to 631 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:50 (BC056415).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:51 (BC047673; N-terminal EF-hand calcium binding protein 3; NECAB3).

In some embodiments, a subject target antigen comprises from about 6, 7, 8, 9, 10, 1, 12, 13-15, 15-17, 17-20, from 20 to 25, from 25 to 50, from 50 to 75, from 75 to 100, from 100 to 150, from 150 to 200, from 200 to 300, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:51 (BC047673); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 an to 300 aa, or from 300 aa to 362 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:51 (BC047673).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:52 (NM_002201; interferon stimulated exonuclease gene 20 kDa; ISG20).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:52 (NM 002201); and has a length of 6 amino acids (an), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, or from 150 aa to 181 an.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:52 (NM 002201).

In some embodiments, a subject target antigen comprises from about 6, 7, 8, 9, 10, 11, 12, 13-15, 15-17, 17-20, from 20 to 25, from 25 to 50, from 50 to 75, from 75 to 80, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:53 (BC060319; chromosome 19 open reading frame 33; C19orf33).

In some embodiments, a subject target antigen comprises from about 6, 7, 8, 9, 10, 11, 12, 13-15, 15-17, 17-20, from 20 to 25, from 25 to 50, from 50 to 75, from 75 to 80, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:53 (BC060319); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 75 aa, or from 75 aa to 85 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:53 (BC060319).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:54 (NM_003141; *Homo sapiens* tripartite motif-containing 21; TRIM21).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:54 (NM_003141); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 as, from 50 aa to 100 aa, from 100 aa to 150 aa, from 150 aa to 200 aa, from 200 aa to 300 aa, from 300 to 400, or from 400 aa to 475 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:54 (NM_003141).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids (an) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:55 (NM_139162; *Homo sapiens* Smith-Magenis syndrome chromosome region, candidate 7 (SMCR7), transcript variant 1; SMCR7).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300) to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:55 (NM_139162); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 as, from 50 aa to 100 aa, from 100 aa to 150 aa, from 150 aa to 200 aa, from 200 aa to 300 aa, from 300 aa to 400 aa, or from 400 aa to 454 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:55 (NM_139162).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:56 (NM_004596; small nuclear ribonucleoprotein polypeptide A; SNRPA).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:56 (NM_004596); and has a length of 6 amino acids (aa), 7 aa, 8 aa, 9 aa, 10 aa, 11 aa, from 12 an to 15 aa, from 15 aa to 20 aa, from 20 an to 25 aa, from 25 aa to 30 aa, from 30 aa to 40 aa, from 40 aa to 50 aa, from 50 aa to 100 aa, from 100 aa to 150 aa, from 150 aa to 200 aa, or from 200 an to 282 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:56 (NM_004596).

In some embodiments, a subject target antigen comprises from about 6, 7, 8, 9, 10, 11, 12, 13-15, 15-17, 17-20, from 20 to 25, from 25 to 50, from 50 to 75, from 75 to 100, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:57 (NM_001004; ribosomal protein, large, P2; RPLP2).

In some embodiments, a subject target antigen comprises from about 6, 7, 8, 9, 10, 11, 12, 13-15, 15-17, 17-20, from 20 to 25, from 25 to 50, from 50 to 75, from 75 to 100, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:57 (NM_001004); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, or from 100 aa to 115 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:57 (NM_001004).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:58 (BC004410; castor zinc finger 1; CASZ1).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:58 (BC004410); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, from 500 aa to 600 aa, or from 600 aa to 614 an.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:58 (BC004410).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:59 (NM_003089; small nuclear ribonucleoprotein 70 kDa polypeptide; SNRP70).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:59 (NM_003089); and has a length of 6 amino acids (aa), 7 aa, 8 aa, 9 aa, 10 aa, 11 aa, from 12 aa to 15 aa, from 15 aa to 20 aa from 20 aa to 25 aa, from 25 aa to 30 aa, from 30 an to 40 aa, from 40 aa to 50 aa, from 50 aa to 100 aa, from 100 aa to 150 aa, from 150 aa to 200 aa, from 200 aa to 300 aa, from 300 aa to 400 aa, or from 400 aa to 437 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:59 (NM_003089).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:60 (NM_003093; small nuclear ribonucleoprotein polypeptide C; SNRPC).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:60 (NM_003093); and has a length of 6 amino acids (aa), 7 aa, 8 at, 9 aa, 10 aa, 11 aa, from 12 aa to 15 aa, from 15 aa to 20 aa, from 20 aa to 25 aa, from 25 as to 30 aa, from 30 aa to 40 aa, from 40 aa to 50 aa, from 50 aa to 100 aa, from 100 aa to 150 aa, or from 150 aa to 159 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:60 (NM_003093).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:61 (NM_004113; fibroblast growth factor 12; FGF12).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:61 (NM_004113); and has a length of 6 amino acids (aa), 7 aa, 8 at, 9 aa, 10 aa, 11 at, from 12 aa to 15 aa, from 15 aa to 20 aa, from 20 aa to 25 aa, from 25 as to 30 aa, from 30 aa to 40 aa, from 40 aa to 50 aa, from 50 aa to 100 aa, from 100 aa to 150 aa, or from 150 aa to 181 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:61 (NM_004113).

In some embodiments, a subject target antigen comprises from about 6, 7, 8, 9, 10, 11, 12, 13-15, 15-17, 17-20, from 20 to 25, from 25 to 50, from 50 to 75, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:62 (NM_018584; calcium/calmodulin-dependent protein kinase II inhibitor 1; CAMK2N1).

In some embodiments, a subject target antigen comprises from about 6, 7, 8, 9, 10, 11, 12, 13-15, 15-17, 17-20, from 20 to 25, from 25 to 50, from 50 to 75, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:62 (NM_018584); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, or from 50 aa to 78 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:62 (NM_018584).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:63 (BC024289; interferon, alpha-inducible protein 6; IFI6).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:63 (BC024289); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 as to 400 aa, or from 400 aa to 471 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:63 (BC024289).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:64 (BC012289; KIAA0515).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:64 (BC012289); and has a length of 6 amino acids (aa), 7 aa, 8 aa, 9 aa, 10 aa, 11 aa, from 12 aa to 15 aa, from 15 aa to 20 as, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, or from 300 aa to 326 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:64 (BC012289).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:65 (BC031262; catenin (cadherin-associated protein), alpha 1; CTNNA1).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99)%, or 100% amino acid sequence identity to the amino acid sequence set forth in SEQ ID NO:65 (BC031262); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, 300 aa to 400 aa, 400 aa to 500 aa, or from 500 aa to 536 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:65 (BC031262).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:66 (NM_012325).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:66 (NM_012325; microtubule-associated protein, RP/EB family, member 1; MAPRE1); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, or from 200 aa to 268 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:66 (NM_012325).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:67 (NM_024946; NEFA-interacting nuclear protein NIP30).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:67 (NM_024946); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, or from 200 aa to 254 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:67 (NM_024946).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:68 (NM_012472; leucine rich repeat containing 6; LRRC6).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:68 (NM_012472); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 an to 40 aa, from 40 aa to 50 aa, from 50 aa to 100 aa, from 100 aa to 150 aa, from 150 aa to 200 aa, from 200 aa to 300 aa, from 300 aa to 400 aa, or from 400 aa to 466 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:68 (NM_012472).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:69 (NM_002576).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:69 (NM_002576); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 an, from 300 an to 400 aa, from 400 aa to 500 aa, or from 500 aa to 545 an.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:69 (NM_002576).

In some embodiments, a subject target antigen comprises from about 6, 7, 8, 9, 10, 11, 12, 13-15, 15-17, 17-20, from 20 to 25, from 25 to 50, from 50 to 75, from 75 to 100, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:70 (NM_173541).

In some embodiments, a subject target antigen comprises from about 6, 7, 8, 9, 10, 11, 12, 13-15, 15-17, 17-20, from 20 to 25, from 25 to 50, from 50 to 75, from 75 to 100, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:70 (NM_173541); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 75 aa, from 75 aa to 100 aa, or from 100 aa to 145 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:70 (NM_173541).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:71 (NM_006374).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:71 (NM_006374); and has a length of 6 amino acids (aa), 7 aa, 8 aa, 9 aa, 10 aa, 11 aa, from 12 aa to 15 aa, from 15 aa to 20 aa from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, or from 400 aa to 426 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:71 (NM_006374).

In some embodiments, a subject target antigen comprises from about 6, 7, 8, 9, 10, 11, 12, 13-15, 15-17, 17-20, from 20 to 25, from 25 to 50, from 50 to 75, front 75 to 100, from 100 to 150, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:72 (NM_032350).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:72 (NM_032350); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 as to 30 aa, from 30 aa to 40 aa, from 40 aa to 50 aa, from 50 an to 75 aa, from 75 aa to 100 aa, from 100 aa to 150 aa, or from 150 aa to 194 an.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:72 (NM_032350).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 750, from 750 to 1000, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:73 (NM_005158).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 750, from 750 to 1000, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:73 (NM_005158); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, from 500 an to 750 aa, from 750 aa to 1000 aa, or from 1000 aa to 1.146 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:73 (NM_005158).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:74 (NM_006479).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:74 (NM_006479); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, or from 300 aa to 335 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:74 (NM_006479).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200) to 300, from 300 to 400, from 400 to 500, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:75 (NM_032141).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:75 (NM_032141); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 2010 aa to 300 aa, from 300 aa to 400 aa, from 400 aa to 500 aa, or from 500 aa to 558 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:75 (NM_032141).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 750, from 750 to 1000, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:76 (BC053895).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 750, from 750 to 1000, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:76 (BC053895); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, from 500 aa to 750 as, from 750 aa to 1000 aa, or from 1000 aa to 1.242 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:76 (BC053895).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 750, from 750 to 1000, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:77 (NM_002609).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 750, from 750 to 100, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:77 (NM_002609); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 as to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 an to 500 aa, from 500 aa to 750 aa, from 750 aa to 1000 aa, or from 1000 aa to 1.106 an.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:77 (NM_002609).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100) to 150, from 150 to 200, from 200 to 300, from 300 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:78 (NM_203284).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:78 (NM_203284); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, or from 400 aa to 486 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:78 (NM_203284).

In some embodiments, a subject target antigen comprises from about 6, 7, 8, 9, 10, 11, 12, 13-15, 15-17, 17-20, from 20 to 25, from 25 to 50, from 50 to 75, front 75 to 100, from 100 to 150, from 150 to 200, from 200 to 300, from 300 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:79 (BC020221).

In some embodiments, a subject target antigen comprises from about 6, 7, 8, 9, 10, 11, 12, 13-15, 15-17, 17-20, front 20 to 25, from 25 to 50, from 50 to 75, from 75 to 100, from 100 to 150, from 150 to 200, from 200 to 300, from 300 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at SEQ ID NO: about 99%, or 100% amino acid sequence identity to the amino acid sequence set forth in SEQ ID NO:79 (BC020221); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, or from 400 aa to 402 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:79 (BC020221).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:80 (BC014991).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:80 (BC014991); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 293 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:80 (BC014991).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:81 (NM_005850).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 3001 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:81 (NM_005850); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, or from 400 aa to 424 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:81 (NM_005850).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, from 600 to 700, from 700 to 800, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:82 (NM_000142).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, from 600 to 700, from 700 to 800, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:82 (NM_000142); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, from 500 aa to 600 aa, from 600 aa to 700 aa, from 700 aa to 800 aa, or from 800 aa to 806 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:82 (NM_000142).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:83 (BC018722).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:83 (BC018722); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, or from 500 aa to 553 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:83 (BC018722).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:84 (NM_032345).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:84 (NM_032345); and has a length of 6 amino acids (aa), 7 aa 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, or from 200 aa to 204 an.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:84 (NM_032345).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:85 (BC009993).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:85 (BC009993); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, or from 300 aa to 354 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:85 (BC009993).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, up to 460 or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:148 (IRAK4; interleukin-1 receptor-associated kinase 4); and may have a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 350 aa, from 350 aa to 400 aa, or from 400 aa to 460 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:148 (IRAK4).

In some embodiments, a subject target antigen comprises from about 6, 7, 8, 9, 10, 11, 12, 13-15, 15-17, 17-20, from 20 to 25, from 25 to 50, from 50 to 75, from 75 to 100, up to 120 or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO: 149 (LOC400027); and may have a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, or from 100 aa to 120 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:149 (LOC400027).

In some embodiments, a subject SLE-associated self-antigen differs in amino acid sequence by 1, 2, 3, 4, 5, 6, 7, 8, 9, 10, from 10 to 15, from 15 to 20, or from 20 to 25, amino acids compared to the amino acid sequence set forth in any one of SEQ ID NOs:43-85, 148, and 149.

Panel

The present disclosure provides a panel of 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, or 45 of the above-described SLE-associated self-antigens or isolated target antigens. A subject panel is useful for detecting in a biological sample the presence of antibody to the two or more antigens.

In some embodiments, two or more of the target antigens will be detectably labeled with distinguishable detectable labels, e.g., a first target antigen is labeled with a first detectable label, a second target antigen is labeled with a second detectable label, etc., where the first and the second (and any additional) detectable labels are distinguishable from one another.

In some embodiments, a subject panel comprises two or more SLE-associated self-antigen, where the antigens are immobilized on an insoluble support.

Type-1 Diabetes-Associated Self-Antigens

Self-antigens that are the target of an immune response generated in an individual who has type 1 insulin dependent diabetes mellitus (referred to herein as "type 1 diabetes-associated self-antigens") include, but are not limited to, those shown in Table 3, below.

TABLE 3

| Name | GenBank Accession No. | Name | GenBank Accession No. |
|---|---|---|---|
| NUP50 | NM_007172 | PDK1 | NM_002613 |
| ABL1 | NM_005157 | NEK3 | NM_002498 |

TABLE 3-continued

| Name | GenBank Accession No. | Name | GenBank Accession No. |
|---|---|---|---|
| ATF2 | BC026175 | ZAP-70 | NM_001079 |
| ATF2 | BC130335 | transglutaminase 2 | BC003551 |
| PAK1 | NM_002576 | coilin (COIL) | NM_004645 |
| CHEK2 | NM_001005735 | MAPK9 (JNK2) | NM_002752 |
| SPEG | NM_005876 | PRKCG | NM_002739 |
| MAP2K (MEK1) | NM_002755 | UBXN6 | NM_025241 |
| PRKCB2 | NM_002738 | PRKCE | NM_005400 |
| adducin 2 (beta) | BC065525 | UBE2H | NM_003344 |
| PLK1 | NM_005030 | ABL2 | NM_005158 |
| NLK | NM_016231.2 | PRKCB1 | NM_002738.5 |
| MGC2827 | NM_023940.1 | MGC2478 | BC002568.1 |
| PRKCZ | NM_002744.2 | C19orf57 | BC012945.1 |

The present disclosure provides an isolated target antigen wherein the isolated target antigen comprises an amino acid sequence that is substantially similar to an antigenic sequence of a type 1 diabetes-associated self-antigen. The present disclosure also provides antigenic fragments and variants of type 1 diabetes-associated self-antigens. In some embodiments, a subject isolated target antigen is synthetic, e.g., a subject synthetic target antigen is synthesized chemically in a laboratory.

A subject isolated target antigen can be from 6 amino acids in length up to the length of a naturally-occurring type 1 diabetes-associated self-antigen, e.g., a subject isolated target antige can be 6 amino acids (aa), 7 aa, 8 aa, 9 aa, 10 aa, 11 aa, 12-15 aa, 15-20 aa, 20-25 aa, 25-30 aa, 30-40 aa, 40-50 aa, 50-100 aa, or longer than 100 amino acids, e.g., 100 aa to 150 aa, 150 aa to 200 aa. In some embodiments, a subject isolated target antigen has a length of from about 6 aa to about 150 aa, e.g., from about 6 aa to about 10 aa, from about 10 an to about 15 aa, from about 15 aa to about 20 aa, from about 20 aa to about 25 aa, from about 25 aa to about 30 aa, from about 30 aa to about 40 aa, from about 40 aa to about 50 aa, from about 50 aa to about 75 aa, from about 75 aa to about 100 aa, from about 100 aa to about 125 aa, or from about 125 aa to about 150 an.

In some embodiments, a subject isolated target antigen comprises from about 6, 7, 8, 9, 10, 11, 12, 13-15, 15-17, 17-20, from 20 to 25, from 25 to 50, from 50 to 75, from 75 to 100, or from 100 to 150, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in one of the following GenBank Accession Numbers: NM_007172, NM_005157, BC026175, BC130335, NM_002576, NM_001005735, NM_005876. NM_002755, NM_002738, BC065525, NM 005030, NM_002613, NM_002498, NM_001079, BC003551, NM_004645, NM_002752, NM_002739, NM_025241, NM_005400, NM_003344, NM_005158, NM_016231.2, NM_023940.1, NM_002744.2, NM_002738.5, BC002568.1, and BC012945.1.

In some embodiments, a subject target antigen comprises from about 6, 7, 8, 9, 10, 11, 12, 13-15, 15-17, 17-20, from 20 to 25, from 25 to 50, from 50 to 75, from 75 to 100, or from 100 to 150, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in one of SEQ ID NOs:86-107 and 150-155.

In some embodiments, a subject target antigen comprises from about 6, 7, 8, 9, 10, 11, 12, 13-15, 15-17, 17-20, from 20 to 25, from 25 to 50, from 50 to 75, from 75 to 100, or from 100 to 150, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in one of SEQ ID NOs: 86-107 and 150-155; and has a length of 6 amino acids (aa), 7 aa, 8 aa, 9 aa, 10 aa, 11 aa, from 12 aa to 15 aa, from 15 to 20 aa, from 20 to 25 aa, from 25 to 30 aa, from 30 to 40 aa, from 40 to 50 aa, from 50 to 100 aa, from 100 aa to 150 aa, or from 150 aa to 200 aa.

In some embodiments, a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in one of SEQ ID NOs:86-107 and 150-155.

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:86 (NM_007172).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:86 (NM_007172); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, or from 400 aa to 468 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:86 (NM_007172).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 1000, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:87 (NM_005157).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 50 to 100, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:87 (NM_005157); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, from 500 aa to 1000 aa, or from 1000 aa to 1130 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:87 (NM_005157).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:88 (BC026175).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, hunt 150 to 200, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:88 (BC026175); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 an to 30 aa, from 30 aa to 40 aa, from 40 an to 50 aa, from 50 aa to 100 aa, from 100 aa to 150 aa, from 150 aa to 200 aa, or from 200 aa to 209 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:88 (BC026175).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:89 (BC130335).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:89 (BC130335); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, or from 500 aa to 505 an.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:89 (BC130335).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:90 (NM_002576).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:90 (NM_002576); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, or from 500 aa to 545 as.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:90 (NM_002576).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:91 (NM_001005735).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO: 91 (NM_001005735); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, or from 500 aa to 586 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:91 (NM_001005735).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300), from 300 to 400, from 400 to 500, from 500 to 1000, from 1000 to 1500, from 1500 to 2000, from 2000 to 2500, from 2500 to 3000, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:92 (NM_005876).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 1000, from 1000 to 1500, from 1500 to 2000, from 2000 to 2500, from 2500 to 3000, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:92 (NM_005876); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, from 500 aa to 1000 aa, from 1000 aa to 1500 aa, from 1500 aa to 2000 aa, from 2000 aa to 2500 aa, from 2500 aa to 3000 aa, or from 3000 aa to 3267 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:92 (NM_005876).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:93 (NM_002755).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:93 (NM_002755); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, or from 300 aa to 393 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:93 (NM_002755).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:94 (NM_002738).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:94 (NM_002738); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, or from 600 aa to 673 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:94 (NM_002738).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, from 600 to 700, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:95 (BC065525).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, from 600 to 700, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:95 (BC065525); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, from 500 aa to 600 aa, from 600 aa to 700 aa, or from 700 aa to 726 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:95 (BC065525).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 3 to 400, from 400 to 500, from 500 to 600, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:96 (NM_005030).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500) to 600, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:96 (NM 005030); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 an to 500 aa, from 500 an to 600 aa, or from 600 aa to 603 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:96 (NM_005030).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:97 (NM_002613).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:97 (NM_002613); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, or from 500 aa to 556 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:97 (NM_002613).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:98 (NM_002498).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:98 (NM_002498); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, or from 500 aa to 506 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:98 (NM_002498).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:99 (NM_001079).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:99 (NM_001079); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, from 500 aa to 600 aa, or from 600 an to 619 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:99 (NM_001079).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:100 (BC003551).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:100 (BC003551); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, or from 500 aa to 548 an.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:100 (BC003551).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:101 (NM_004645).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:101 (NM_004645); and has a length of 6 amino acids (an), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 as, from 300 an to 400 aa, from 400 aa to 500 aa, or from 500 aa to 576 an.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO: 101 (NM_004645).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:102 (NM_002752).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:102 (NM_002752); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, or from 400 aa to 424 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:102 (NM_002752).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:103 (NM_002739).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:103 (NM_002739); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, from 500 aa to 600 aa, or from 600 aa to 697 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:103 (NM_002739).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:104 (NM_025241).

In some embodiments, a subject target antigen comprises from about 6, 7, 8.9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, or more, contiguous amino acids of an amino acid sequence having at least about 50%, at least about 600%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:104 (NM_025241); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, or from 400 aa to 441 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:104 (NM_025241).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, from 600 to 700, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:105 (NM_005400).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, from 600 to 700, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO: 105 (NM_005400); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 40 aa to 500 aa, from 500 aa to 600 aa, from 600 aa to 700 aa, or from 700 aa to 737 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:105 (NM_005400).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100) to 150, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:106 (NM_003344).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:106 (NM_003344); and has a length of 6 amino acids (aa), 7 aa, 8 aa, 9 aa 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, or from 150 aa to 183 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:106 (NM_003344).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, from 600 to 700, from 700 to 800, from 800 to 900, from 900 to 1000, or more, contiguous amino acids (aa) of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:107 (NM_005158).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 150, from 150 to 200, from 200 to 300, from 300 to 400, from 400 to 500, from 500 to 600, from 600 to 700, from 700 to 800, from 800 to 900, from 900 to 1000, or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:107 (NM_005158); and has a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, from 500 aa to 600 aa, from 600 aa to 700 aa, from 700 aa to 800 aa, from 800 aa to 900 aa, from 900 aa to 1,000 aa, or from 1,000 aa to 1.146 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:107 (NM_005158).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 200, from 200 to 300, from 300 to 400, from 400 up to 527 or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:150 (memo-like kinase (NLK)); and may have a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, or from 400 aa to 527 an.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:150 (nemo-like kinase (NLK)).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 200, from 200 up to 248 or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:151 (MGC2827; RASL11B); and may have a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, or from 200 aa to 248 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:151 (MGC2827; RASL11B).

In some embodiments, a subject target antigen comprises from about 6, 7, 8, 9, 10, 11, 12, 13-15, 15-17, 17-20, from 20 to 25, from 25 to 50, from 50 to 75, from 75 to 100, front 100 to 200, from 200 to 300, from 300 to 400, from 400 to 500, up to 592 or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:152 (protein kinase C, zeta (PRKCA)); and may have a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, or from 500 aa to 592 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:152 (protein kinase C, zeta (PRKCZ)).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 200, from 200 to 300, from 300 to 400, from 400 to 500, from 500 to 600, up to 673 or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:153 (protein kinase Cβ (PRKCB1)); and may have a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, from 500 aa to 600 aa, or from 600 aa to 673 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:153 (protein kinase Cβ (PRKCB1)).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 200, from 200 to 300, up to 312 or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:154 (MGC2478; cytokine induced apoptosis inhibitor 1); and may have a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, or from 300 aa to 312 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:154 (MGC2478; cytokine induced apoptosis inhibitor 1).

In some embodiments, a subject target antigen comprises from about 6, 7, 8, 9, 10, 11, 12, 13-15, 15-17, 17-20, from 20 to 25, from 25 to 50, from 50 to 75, from 75 to 100, from 100 to 200, from 200 to 300, from 300) to 400, from 400 to 500, from 500 to 600, up to 637 or more, contiguous amino acids of an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:155 (C19orf57) and may have a length of 6 amino acids (aa), 7 aa, 8 aa, 9 aa, 10 aa, 11 aa, from 12 aa to 15 aa, from 15 aa to 20 aa, from 20 aa to 25 aa, from 25 aa to 30 aa, from 30 aa to 40 aa, from 40 aa to 50 aa, from 50 aa to 100 aa, from 100 aa to 150 aa, from 150 aa to 200 aa, from 200 aa to 300 aa, from 300 aa to 400 aa, from 400 aa to 500 aa, from 500 aa to 600 aa, or from 600 as to 637 aa.

In some embodiments a subject target antigen comprises an amino acid sequence having at least about 50%, at least about 60%, at least about 70%, at least about 75%, at least about 80%, at least about 85%, at least about 90%, at least about 95%, at least about 98%, at least about 99%, or 100% amino acid sequence identity to the amino acid sequence set forth in SEQ ID NO:155 (C19orf57).

In some embodiments, a subject type-1 diabetes-associated self-antigen differs in amino acid sequence by 1, 2, 3, 4, 5, 6, 7, 8, 9, 10, from 10 to 15, from 15 to 20, or from 20 to 25, amino acids compared to the amino acid sequence set forth in any one of SEQ ID NOs:86-107 and 150-155.

In some embodiments, one or more of the above type-1 diabetes-associated self-antigens are specifically excluded. For example, in one embodiment, transglutaminases 2 (BC003551) (SEQ ID NO: 100) is specifically excluded.
Panel The present disclosure provides a panel of 2, 3, 4, 5, 6, 7, 8, 9, 10, 11, 12, 13, 14, 15, 16, 17, 18, 19, 21, 22, 23, 24, 25, 26, 27, or 28 of the above-described type 1 diabetes-associated self-antigens or isolated target antigens. A subject panel is useful for detecting in a biological sample the presence of antibody to the two or more antigens.

In some embodiments, two or more of the target antigens will be detectably labeled with distinguishable detectable labels, e.g., a first target antigen is labeled with a first detectable label, a second target antigen is labeled with a second detectable label, etc., where the first and the second (and any additional) detectable labels are distinguishable from one another.

In some embodiments, a subject panel comprises two or more type 1 diabetes-associated self-antigens, where the antigens are immobilized on an insoluble support.
Diagnostic Methods The present disclosure provides methods of diagnosing an autoimmune disorder and methods of identifying individuals at risk of developing an autoimmune disorder, the methods generally involving detecting an antibody response to a target antigen in an individual.

For example, the present disclosure provides methods of diagnosing whether an individual has Systemic Lupus Erythematosus (SLE) and methods of identifying individuals at risk of developing SLE. The present disclosure also provides methods of diagnosing whether an individual has type-1 insulin dependent diabetes mellitus and methods of identifying individuals at risk of developing type-1 insulin dependent diabetes mellitus. These methods are described in detail below.

In one embodiment, a method of diagnosing whether an individual has (or is at risk of developing) Systemic Lupus Erythematosus (SLE) is provided. The method generally involves contacting a biological sample. e.g., serum, from an individual with a subject target antigen and detecting the presence of an immune response specific for the subject target antigen.

In another embodiment, a method of diagnosing whether an individual has (or is at risk of developing) type-1 insulin dependent diabetes mellitus is provided. The method generally involves contacting a biological sample, e.g., serum, from an individual with a subject target antigen and detecting the presence of an immune response specific for the subject target antigen.

Various methods known in the art may be used to determine the presence of an immune response. The biological sample for analysis is typically blood, plasma, serum, mucous or cerebrospinal fluid from the patient. The sample is analyzed for indication of an immune response to any subject target antigen of the invention. The immune response can be determined from the presence of, e.g., antibodies or T-cells that specifically bind to the subject target antigen.

Where T cell responses are of interest, the sample is a sample comprising lymphocytes, e.g. the cellular portion of a blood sample, etc. T cells may be stained with a peptide/MHC complex, for example using detectably labeled MHC reagents (i•TAg™ MHC Tetramers, Beckman Coulter; BD™ DimerX reagents; ProImmune Pro5® MHC class I Pentamers etc.) to determine the presence of T cells having specificity for a subject target antigen. Alternatively. T cells may be assayed in vitro for reactivity to a subject target antigen, using methods known in the art. For example, a sample comprising T cells may be contacted with a subject target antigen presented by an antigen presenting cell; or provided as a stable MHC complex; and the response of the cells quantitated, for example by proliferation, cytokine synthesis, cytotoxicity and the like. Measured values may thus include quantitation of antigen specific T cells, quantitation of T cell proliferation in response to the antigen, quantitation of cytokine release, e.g. IFN-γ, IL-2, etc, in response to presented antigen, percentage of specific cell lysis and the like.

In some embodiments, diagnostic methods involve detecting the number of subject target antigen-specific CD8$^+$ T cells in a biological sample obtained from an individual. The number of subject target antigen-specific CD8$^+$ T cells can be determined using, e.g., a $^{51}$Cr release assay, where target cells pulsed with a subject target antigen and labeled with $^{51}$Cr are contacted with a test sample that may contain subject target antigen-specific CD8 T cells. The number of subject target antigen-specific CD8$^+$ T cells is determined by measuring release of $^{51}$Cr from the target cells.

Some methods may entail determining a baseline value of an immune response in a normal control, and comparing this with a value for the test immune response. A significant difference (i.e., greater than the typical margin of experimental error in repeat measurements of the same sample, expressed as one standard deviation from the mean of such measurements) in value of the immune response relative to a normal control signals the presence of an immune response against a subject target antigen in the sample. If the value for immune response does not change significantly, this signals the lack of an immune response against a subject target antigen in the sample. In other methods, a control value (i.e., a mean and standard deviation) of immune response is determined for a control population. Typically the individuals in the control population are free of the autoimmune disease of interest. Measured values of immune response in a patient may be compared with the control value.

In other methods, a control value of immune response (e.g., a mean and standard deviation) is determined from a control population of individuals who have undergone treatment with a therapeutic agent. Measured values of immune response in a patient are compared with the control value. If the measured level in a patient is not significantly different (e.g., more than one standard deviation) from the control value, treatment can be discontinued. If the level in a patient is significantly below the control value, continued administration of agent is warranted. If the level in the patient persists below the control value, then a change in treatment regime, for example, use of a different adjuvant can be indicated.

In other methods, a patient who is not presently receiving treatment but has undergone a previous course of treatment is monitored for immune response to determine whether a resumption of treatment is required. The measured value of immune response in the patient can be compared with a value of immune response previously achieved in the patient after a previous course of treatment. A significant decrease relative to the previous measurement (i.e., greater than a typical margin of error in repeat measurements of the same sample) is an indication that treatment can be resumed. Alternatively, the value measured in a patient can be compared with a control value (mean plus standard deviation) determined in a population of patients after undergoing a course of treatment. Alternatively, the measured value in a patient can be compared with a control value in populations of prophylactically treated patients who remain free of symptoms of disease, or populations of therapeutically treated patients who show amelioration of disease characteristics. In all of these cases, a significant decrease relative to the control level (i.e., more than a standard deviation) is an indicator that treatment should be resumed in a patient.

Diagnostic Kits

The present disclosure further provides kits for use within any of the above diagnostic methods. Such kits typically comprise two or more components necessary for performing a diagnostic assay for the detection of immune responses specific to a subject target antigen. Components can be compounds, reagents, containers and/or equipment. Kits also typically contain labeling providing directions for use of the kit. For example, one container within a kit can contain a monoclonal antibody or fragment thereof or soluble T cell receptor that specifically binds to a subject target antigen, or to a subject target antigen/MHC complex. Alternatively, an MHC/subject target antigen peptide complex may be included. Such reagents can be provided attached to a support material. One or more additional containers can enclose elements, such as reagents or buffers, to be used in the assay. Such kits can also, or alternatively, contain a detection reagent that contains a reporter group suitable for direct or indirect detection of antibody binding. The term labeling refers to any written or recorded material that is attached to, or otherwise accompanies a kit at any time during its manufacture, transport, sale or use. For example, the term labeling encompasses advertising leaflets and brochures, packaging materials, instructions, audio or video cassettes, computer discs, as well as writing imprinted directly on kits.

In one embodiment, a subject kit comprises a subject target antigen immobilized on a solid support and a labeled reagent capable of binding to an antibody specific for the subject target antigen.

Populations of Interest

The diagnostic methods discussed herein are not limited to use with a particular patient class or population of individuals. However, specific groups of patients/individuals may be of interest in connection with the methods disclosed herein. For example, the subject methods of diagnosing an individual for SLE may be of particular interest in connection with populations of individuals at high risk of developing SLE. e.g., populations of individuals having a family history of SLE, populations of individuals having specific HLA alleles associated with SLE, and populations of individuals having specific SNPs associated with SLE. It may also be of particular benefit to screen children for immune responses to SLE-associated self-antigens since much of the long term organ damage associated with SLE can be prevented with early diagnosis and treatment.

In the context of type-1 insulin dependent diabetes mellitus, it may be beneficial to screen individuals who have not yet been diagnosed on the basis of hyperglycemia since there is generally significant damage to beta islet cells by this point. Additional populations of interest include those with risk factors such as obesity, family history of diabetes and high-risk ethnicity (e.g., Hispanic, Native American, Afro-Caribbean and Pacific Islander.

The diagnostic methods discussed herein may also find use in the diagnosis and/or staging of additional autoimmune disorders including, but not limited to, rheumatoid arthritis, scleroderma, and mixed connective tissue disease.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or see, second(s); min, minute(s); h or hr, hour(s); aa, amino acid(s); kb, kilobase(s); bp, base pair(s); nt, nucleotide(s); i.m., intramuscular(ly); i.p., intraperitoneal(ly); s.c., subcutaneous(ly); Ag, antigen(s); and the like.

Example 1: Identification of Target Antigens in Prostate Cancer Patients Treated with Anti-CTLA-4/GMCSF Combination Immunotherapy In order to identify immune responses unique to patients responsive to immunotherapy, protein arrays were screened with serum from prostate cancer patients characterized as responders or non-responders to anti-CTLA-4/GMCSF combination immunotherapy.

Materials and Methods

A protein array containing 8274 unique proteins was screened with serum from 3 responders and 3 non-responders. 8274 unique proteins were purified from baculovirus and printed on nc coated slides in duplicate+controls. Slides were blocked and then contacted with patient serum diluted 1:500. Following a wash step, anti-human IgG-Alexa Fluor® 647 secondary antibody was added to the slides. Slides were washed again and then imaged on an Axon microarray scanner. For responders and non-responders immune responses were measured both pre- and post treatment. Select target antigens were validated via western blot or immunoprecipitation.

Target antigens can be identified without normalization, as well as with Quantile Normalization and Robust linear Normalization. Where no normalization is utilized, an exemplary protocol is as follows: After scanning the slide with the axon scanner the data are analyzed using Invitrogen Prospector Software. This analysis software examines the fluorescence intensity of each spotted protein and determines if it is a significant hit by using a Z-score of >2.9 as the cutoff criteria. Certain candidates that do not satisfy the >2.9 cutoff because of low signal intensities but have at least a two fold increase in post versus pre-treatment sera and appear more frequently in responders compared to non-responders can also be considered.

Quantile Normalization forces the arrays to have identical intensity distribution so as to allow comparison between arrays that may have systematic measurement errors.

Robust Linear Normalization uses a statistical linear model and positive control proteins. e.g., IgG and V5 to fit the model and also removes systematic measurement errors.

Results

Target antigens exhibiting a greater immune response in responders relative to non-responders are listed in Table 1 above. FIG. 1 shows the results of a western blot assay designed to validate an exemplary target antigen. As indicated in FIG. 1, an immune response to the target antigen SYK is visible for a responder patient (24-8) post treatment. A similar response is not seen for non-responder (23-8) post treatment. (24-1) and (23-1) represent pre-treatment responses for responder and non-responder patients respectively.

FIGS. 2A-D show the results of an immunoprecipitation assay designed to validate exemplary target antigens. As shown in FIGS. 1 and 2A-D, the target antigens SYK. PAK6, and MITF each show increased immune response post-treatment in responders. An increase in immune response to SYK and MITF is observed only in patient 24. PAK6 shows an increase in immune response post-treatment for responders 19 and 20 and also one non-responder 22. In FIGS. 2A-D, pre-existing antibodies to the antigen CSAG1a are observed in responders 19 and 24, and not in any of the non-responders (21, 22 and 23), 21-1 and 21-8 show results for a non-responder (21) pre-treatment (-1) and post-treatment (-8), 22-1 and 22-8 show results for a non-responder (22) pre-treatment (-1) and post-treatment (-8), 23-1 and 23-8 show results for a non-responder (23) pre-treatment (-1) and post-treatment (-8). 19-1 and 19-8 show results for a responder (19) pre-treatment (-1) and post-treatment (-8), 20-1 and 20-8 show results for a responder (20) pre-treatment (-1) and post-treatment (-8), 24-1 and 24-8 show results for a responder (24) pre-treatment (-1) and post-treatment (-8).

Example 2: Induction of Auto-Antibodies in SLE Patients

In order to identify new SLE-associated self-antigens, plasma from normal individuals or individuals with SLE was used to screen human protein arrays.

Materials and Methods

Plasma from 11 SLE and 5 Normal Individuals was used to screen protein arrays (Invitrogen Photoarrays). Each slide was spotted with 8000 different human proteins in duplicate. Arrays were blocked and plasma was added. After washing 5×, arrays were contacted with Alexa647 labeled secondary antibody. The arrays were then scanned using an Axon scanner, and the data was analyzed using Invitrogen's Prospector Free Software. The Prospector analysis software examines the flourescence intensity of each spotted protein and determines if it is a significant hit by using a Z-score of >3 as the cutoff criteria.

Results 38 different self-antigens were identified which showed significant fluorescence when exposed to serum from individuals with SLE as compared to normal controls. Table 4 below represents some of the detected antibody responses to known SLE-associated nuclear antigens (Ags).

TABLE 4

| Known Auto-Ags | Description |
| --- | --- |
| Ro-52 | Associated with Ro-RNP complex; Ubiquitin |
| SMITH | Associated with snRNA's to make up the snRNP complex |
| RNP complex | Mediates the splicing of pre-mRNA |
| ssDNA | |

In addition, several proteins not previously identified as SLE-associated self-antigens were identified. These proteins are set forth in Table 2 above.

Two of the proteins which exhibited high fluorescent values when contacted with serum from individuals with SLE were validated as discussed below in Example 3.

Example 3: Validation of Selected SLE-Associated Self-Antigens

Selected proteins identified via screening of the protoarrays were validated as SLE-associated self-antigens as follows.

Materials and Methods

The genes encoding the selected candidate SLE-associated self-antigens were cloned into a GST-fusion expression vector and expressed in-vitro using a rabbit reticulolysate coupled transcription/translation system. The expressed protein was then incubated with SLE or normal plasma. The protein-antibody complex was then bound to protein A sepharose beads, washed, spun, and diluted in Lammelli buffer for SDS-PAGE.

Results

Figure 3:
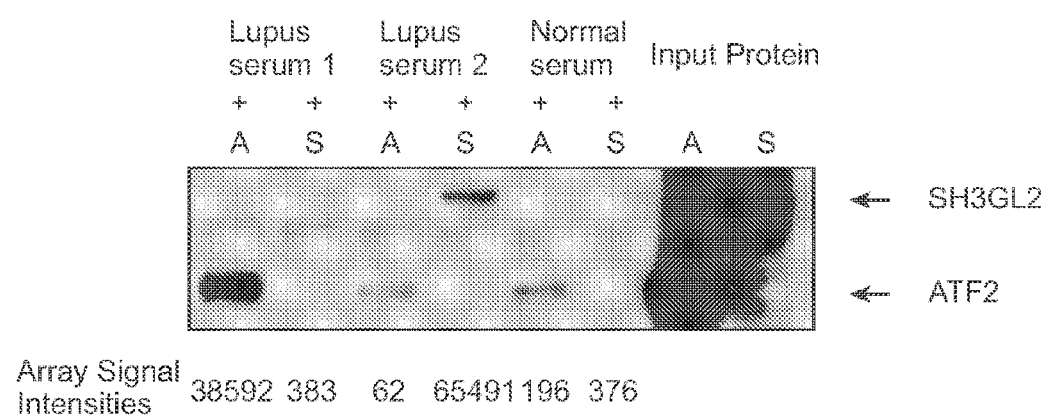
FIG. 3 shows the results of a western blot assay designed to validate two candidate SLE-associated self-antigens.

FIG. 3 shows western blot results for the above experiment. Candidates were considered validated if a stronger band was present for SLE serum with+protein as compared with normal serum+the same protein. ATF2 is expected to be around 63 kDa, and SH3GL2 is expected to be around 93 kDa. FIG. 3 shows stronger bands at about 63 kDa and 93 kDa (for ATF2 and SH3GL2 respectively) for SLE serum relative to normal serum. Based on these results, ATF2 and SH3GL2 were validated as SLE-associated self-antigens.

Example 4: Induction of Auto-Antibodies in Type-1 Insulin Dependent Diabetes Mellitus Patients In order to identify new type 1 diabetes-associated self-antigens, plasma from normal individuals or individuals with type 1 diabetes was used to screen human protein arrays.

Materials and Methods

Plasma from type-1 diabetes and normal individuals was used to screen protein arrays (Invitrogen Protoarrays). Each slide was spotted with 8000 different human proteins in duplicate. Arrays were blocked and plasma was added. After washing 5×, arrays were contacted with Alexa647 labeled secondary antibody. The arrays were then scanned using an Axon scanner, and the data was analyzed using Invitrogen's Prospector Free Software. The Prospector analysis software examines the flourescence intensity of each spotted protein and determines if it is a significant hit by using a Z-score of >3 as the cutoff criteria.

Results

Self-antigens were identified which showed significant fluorescence when exposed to serum from individuals with type-1 diabetes as compared to normal controls.

Several proteins not previously identified as type 1 diabetes-associated self-antigens were identified. These proteins are set forth in Table 3 above.

Example 5: Immunohistochemical Analysis of Biopsies and Tumors

The results of immunohistochemical analysis of biopsies and tumors are shown in FIGS. 4A-L. Low grade tumor (a, d), high grade tumor (b, e), and patient 20's high grade tumor biopsy (c, f). Sections a, b and c were stained with anti-Pak6 antibodies (Novus Biologicals, NLS6942) and sections d, e and f were stained with normal rabbit IgG (Dako, X0903). Low grade tumor (g, h, and 1), high grade tumor (j, k) and patient 24's high grade tumor biopsy (i), g and h shows the tumor and benign regions respectively of the same tumor section; and j and k shows the tumor and benign regions respectively of the same tumor section. There is no benign region in patent 24 tumor biopsy. Sections g to l were stained with anti-Syk antibodies (Sigma, HPA001384).

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (155 sequences)

SEQ ID NO: 1 - protein, 352 aa, Homo sapiens
MAPKLITVLCLGFCLNQKICPHAGAQDKFSLSAWPSPVVPLGGRVTLSCHSHLRFVIWTIFQTTGTRSHELHTGLSNNITISPVTPEHAGTYRCVGIYKHASKWSAESNSLKIIVTGLFTKPSISAHPSSLVHAGARVSLRCHSELAFDEFILYKEGHIQHSQQLDQGMEAGIHYVEAVFSMGPVTPAHAGAYRCCGCFSHSRYEWSAPSDPLDIVITGKYKKPSLSTQVDPMMRLGEKLTLFCSSEISFDQYHLFRHGVAHGQWLSGGQRHREAFQANFSVGRATPVPGGTYRCYGSFNDSPYKPPVTRCNFTPQETLRVLLCHSQNPPLNLTHLALKDSPATCICSLDSQ

SEQ ID NO: 2 - protein, 344 aa, Homo sapiens
MAQKENSYPWPYGRQTAPSGLSTLPQRVLRKEPVTPSALVLMSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPMGAQDLISKLLRHNPSERLPLAQVSAHPWVRANSRRVLPPSALQSVA

SEQ ID NO: 3 - protein, 646 aa, Homo sapiens
MEPAAGFLSPRPFQRAAAAPAPPAGPGPPPSALRGPELEMLAGLPTSDPGRLITDPRSGRTYLKGRLLGKGGFARCYEATDTETGSAYAVKVIPQSRVAKPHQREKILNEIELHRDLQHRHIVRFSHHFEDADNIYIFLELCSRKSLAHIWKARHTLLEPEVRYYLRQILSGLKYLHQRGILHRDLKLGNFFITENMELKVGDFGLAARLEPPEQRKKTICGTPNYVAPEVLLRQGHGPEADVWSLGCVMYTLLCGSPPFETADLKETYRCIKQVHYTLPASLSLPARQLLAAILRASPRDRPSIDQILRHDFFTKGYTPDRLPISSCVTVPDLTPPNPARSLFAKVTKSLFGRKKKSKNHAQERDEVSGLVSGLMRTSVGHQDARPEAPAASGPAPVSLVETAPEDSSPRGTLASSGDGFEEGLTVATVVESALCALRNCIAFMPPAEQNPAPLAQPEPLVWVSKWVDYSNKFGFGYQLSSRRVAVLFNDGTHMALSANRKTVHYNPTSTKHFSFSVGAVPRALQPQLGILRYFASYMEQHLMKGGDLPSVEEVEVPAPPLLLQWVKTDQALLMLFSDGTVQVNFYGDHTKLILSGWEPLLVTFVARNRSACTYLASHLRQLGCSPDLRQRLRYALRLLRDRSPA

SEQ ID NO: 4 - protein, 293 aa, Homo sapiens
MPARSGAQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 5 - protein, 445 aa, Homo sapiens
MPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPELLNLPSSVIKKKVHFSGESKENIMRSENSESQLTSKSKCKDLKKRLHAAQLRAQALSDIEKNYQLKSRQILGMR

SEQ ID NO: 6 - protein, 71 aa, Homo sapiens
MERARDRLHLRRTTEQHVPEVEVQVKRRRTASLSNQECQLYPRRSQQQQVPVVDFQAELRQAFLAETPRGG

SEQ ID NO: 7 - protein, 1101 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 8 - protein, 499 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 9 - protein, 681 aa, Homo sapiens
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHWATDPDMYLQSPQSERTDPHGLYLSCNGGTPAGHKQMPWPEPQSPRVLPNGLAAKAQSLGPAEFQGASQRCLQLGACLQSSPPGASPPTGTNRHGMKAAKHGSEEARPQSCLVGSATGRPGGEGSPSPKTRESSLKRRLFRSMFLSTAATAPPSSSKPGPPPQSKPNSSFRPPQKDNPPSLVAKAQSLPSDQPVGTFSPLTTSDTSSPQKSLRTAPATGQLPGRSSPAGSPRTWHAQISTSNLYLPQDPTVAKGALAGEDTGVVTHEQFKAALRMVVDQGDPRLLLDSYVKIGEGSTGIVCLAREKHSGRQVAVKMMDLRKQQRRELLFNEVVIMRDYQHFNVVEMYKSYLVGEELWVLMEFLQGGALTDIVSQVRLNEEQIATVCEAVLQALAYLHAQGVIHRDIKSDSILLTLDGRVKLSDFGFCAQISKDVPKRKSLVGTPYWMAPEVISRSLYATEVDIWSLGIMVIEMVDGEPPYFSDSPVQAMKRLRDSPPPKLKNSHKVSPVLRDFLERMLVRDPQERATAQELLDHPFLLQTGLPECLVPLIQLYRKQTSTC

SEQ ID NO: 10 - protein, 415 aa, Homo sapiens [sequence omitted]

SEQ ID NO: 11 - protein, 415 aa, Homo sapiens
MDFDKKGGKGETEEGRRMSKAGGGRSSHGIRSSGTSSGVLMVGPNFRVGKKIGCGNFGELRLGKNLYTNEYVAIKLEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPHSKNQALNSTNGELNADDPTAGHSNAPITAPAEVEVADETKCCCFFKRRKRKSLQRHK

SEQ ID NO: 12 - protein, 317 aa, Homo sapiens
MRKTSNSCIMENGHQPGTGPGDGPPEIAQNFSAPDPPRPRPVSLSLRLPHQPVTAITRVSDRFSGETSAAALSPMSAATLGGLNPSPSEVITPWTPSPSEKNSSFTWSVPSSGYGAVTASKHSNSPPLVTPPQSPVSPQPPAITQVHRQGERRRELVRSQTLPRTSEAQARKALFEKWEQETAAGKGKGEARARLKRSQSFGVASASSIKQILLEWCRSKTLGYQHVDLQNFSSSWSDGMAFCALVHSFFPDAFDYNSLSPTQRQKNFELAFTMAENLANCERLIEVEDMMVMGRKPDPMCVFTYVQSLYNHLRRFE

SEQ ID NO: 13 - protein, 688 aa, Homo sapiens
MSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVTLDPSKRQNSNRCVSGASLPQGSKIRSQTNLRESGDLRSQVAIYLGIKRKPPPGCSDSPGV

SEQ ID NO: 14 - protein, 167 aa, Homo sapiens
MEETYTDSLDPEKLLQCPYDKNHQIRACRFPYHLIKCRKNHPDVASKLATCPFNARHQVPRAEISHHISSCDDRSCIEQDVVNQTRSLRQETLAESTWQCPPCDEDWDKDLWEQTSTPFVWGTTHYSDNNSPASNIVTEHKNNLASGMRVPKSLPYVLPWKNNGNAQ

SEQ ID NO: 15 - protein, 325 aa, Homo sapiens
MKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKPRRGHQSPTNHGIGSLGCCLPDTPICLCPEGLSPGLLSAESGGRHSGLLSKF

SEQ ID NO: 16 - protein, 1072 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 17 - protein, 78 aa, Homo sapiens
MSATTACWPAFTVLGEARGDQVDWSRLYRDTGLVKMSRKPRASSPFSNNHPSTPKRFPRQPRREKGPVKEVPGTKGSP

SEQ ID NO: 18 - protein, 210 aa, Homo sapiens [sequence omitted]

SEQ ID NO: 19 - protein, 287 aa, Homo sapiens
MHRLMGVNSTAAAAAGQPNVSCTCNCKRSLFQSMEITELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 20 - protein, 481 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 21 - protein, 147 aa, Homo sapiens
MSQTRDLQGGKAFGLLKAQQEERLDEINKQFLDDPKYSSDEDLPSKLEGFKEKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 22 - protein, 292 aa, Homo sapiens [sequence omitted]

SEQ ID NO: 23 - protein, 23 aa, Homo sapiens
MHWEKVDVNNSIKQPYFLIKNDK

SEQ ID NO: 24 - protein, 226 aa, Homo sapiens
MSRIYHDGALRNKAVQSVRLPGAWDPAAHQGGNGVLLEGELIDVSRHSILDTHGRKERYYVLYIRPSHIHRRKFDAKGNEIEPNFSATRKVNTGFLMSSYKVEAKGDTDRLTPEALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWDD

SEQ ID NO: 25 - protein, 154 aa, Homo sapiens
MTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 26 - protein, 695 aa, Homo sapiens
MASTRSIELEHFEERDKRPRPGSRRGAPSSSGGSSSSGPKGNGLIPSPAHSAHCSFYRTRTLQALSSEKKAKKARFYRNGDRYFKGLVFAISSDRFRSFDALLIELTRSLSDNVNLPQGVRTIYTIDGSRKVTSLDELLEGESYVCASNEPFRKVDYTKNINPNWSVNIKGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSECRVLKSSYSRSSAVKYSGSKSPGPSRRSKSPASVNGTPSSQLSTPKSTKSSSSSPTSPGSFRGLKISAHGRSSSNVNGGPELDRCISPEGVNGNRCSESSTLLEKYKIGKVIGDGNFAVVKECIDRSTGKEFALKIIDKAKCCGKEHLIENEVSILRRVKHPNIIMLVEEMETATELFLVMELVKGGDLFDAITSSTKYTERDGSAMVYNLANALRYLHGLSIVHRDIKPENLLVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMFDLTV

SEQ ID NO: 27 - protein, 635 aa, Homo sapiens
MASSGMADSANHLPFFFGNITREEAEDYLVQGGMSDGLYLLRQSRNYLGGFALSVAHGRKAHHYTIERELNGTYAIAGGRTHASPADLCHYHSQESDGLVCLLKKPFNRPQGVQPKTGPFEDLKENLIREYVKQTWNLQGQALEQAIISQKPQLEKLIATTAHEKMPWFHGKISREESEQIVLIGSKTNGKFLIRARDNNGSYALCLLHEGKVLHYRIDKDKTGKLSIPEGKKFDTLWQLVEHYSYKADGLLRVLTVPCQKIGTQGNVNFGGRPQLPGSHPATWSAGGIISRIKSYSFPKPGHRKSSPAQGNRQESTVSFNPYEPELAPWAADKGPQREALPMDTEVYESPYADPEEIRPKEVYLDRKLLTLEDKELGSGNFGTVKKGYYQMKKVVKTVAVKILKNEANDPALKDELLAEANVMQQLDNPYIVRMIGICEAESWMLVMEMAELGPLNKYLQQNRHVKDKNIIELVHQVSMGMKYLEESNFVHRDLAARNVLLVTQHYAKISDFGLSKALRADENYYKAQTHGKWPVKWYAPECINYYKFSSKSDVWSFGVLMWEAFSYGQKPYRGMKGSEVTAMLEKGERMGCPAGCPREMYDLMNLCWTYDVENRPGFAAVELRLRNYYYDVVN

SEQ ID NO: 28 - protein, 88 aa, Homo sapiens
MNAIHTKELLLTSHLQSPPGHRQDPFNKSSSETPIVQNLQLATGYHHSLWLCKIKDLEEGWGGGSYEKRQEKSSFDPMLSESVHEEES

SEQ ID NO: 29 - protein, 79 aa, Homo sapiens
MSEILPYSEDKMGRFGADPEGSDLSFSCRLQDTNSFFAGNQAKRPPKLGQIGRAKRVVIEDDRIDDVLKGMGEKPPSGV

SEQ ID NO: 30 - protein, 310 aa, Homo sapiens
MGKRRCVPPLEPKLAAGCCGVKKPKLSGSGTHSHGNQSTTVPGSSSGPLQNHQHVDSSSGRENVSDLTLGPGNSPITRMNPASGALSPLPRPNGTANTTKNLVVTAEMCCYCFDVLYCHLYGFPQPRLPRFTNDPYPLFVTWKTGRDKRLRGCIGTFSAMNLHSGLREYTLTSALKDSRFPPLTREELPKLFCSVSLLTNFEDASDYLDWEVGVHGIRIEFINEKGVKRTATYLPEVAKEQDWDQIQTIDSLLRKGGFKAPITSEFRKTIKLTRYRSEKVTISYAEYIASRQHCFQNGTLHAPPLYNHYS

SEQ ID NO: 31 - protein, 147 aa, Homo sapiens
MAATTGSGVKVPRNFRLLEELEEGQKGVGDGTVSWGLEDDEDMTLTRWTGMIIGPPRTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 32 - protein, 256 aa, Homo sapiens
MAAVKSTEAHPSSNKDPTQGQKSALQGNSPDSEASRQRFRQFCYQEVTGPHEAFSKLWELCCQWLRPKTHSKEEILELLVLEQFLTILPEEIQTWVREQHPENGEEAVALVEDVQRAPGQQVLDSEKDLKVLMKEMAPLGATRESLRSQWKQEVQPEEPTFKGSQSSHQRPGEQSEAWLAPQAPRNLPQNTGLHDQETGAVVWTAGSQGPAMRDNRAVSLCQQEWMCPGPAQRALYRGATQRKDSHVSLATGALGL

SEQ ID NO: 33 - protein, 70 aa, Homo sapiens
MSEVKSRKKSGPKGAPAAEPGKRSEGGKTPVARSSGGGGWADPRTCLSLLSLGTCLGLACGRNLKLSWNN

SEQ ID NO: 34 - protein, 480 aa, Homo sapiens [sequence omitted]

SEQ ID NO: 35 - protein, 78 aa, Homo sapiens
MSEVLPYGDEKLSPYGDGGDVGQIFSCRLQDTNNFFGAGQNKRPPKLGQIGRSKRVVIEDDRIDDVLKNMTDKAPPGV

SEQ ID NO: 36 - protein, 885 aa, Homo sapiens
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 37 - protein, 403 aa, Homo sapiens
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELKIADFGWSVHAPSSRRTTLCGTLDYLPPEMIEGRMHDEKVDLWSLGVLCYEFLVGKPPFEANTYQETYKRISRVEFTFPDFVTEGARDLISRLLKHNPSQRPMLREVLEHPWITANSSKPSNCQNKESASKQS

SEQ ID NO: 38 - protein, 976 aa, Homo sapiens [sequence omitted]

SEQ ID NO: 39 - protein, 422 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEAKCCCFFKRKRKKTAQRHK

SEQ ID NO: 40 - protein, 416 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 41 - protein, 726 aa, Homo sapiens
MEGERKNNNKRWYFTREQLENSPSRRFGVDPDKELSYRQQAANLLQDMGQRLNVSQLTINTAIVYMHRFYMIQSFTQFPGNSVAPAALFLAAKVEEQPKKLEHVIKVAHTCLHPQESLPDTRSEAYLQQVQDLVILESIILQTLGFELTIDHPHTHVVKCTQLVRASKDLAQTSYFMATNSLHLTTFSLQYTPPVVACVCIHLACKWSNWEIPVSTDGKHWWEYVDATVTLELLDELTHEFLQILEKTPNRLKRIWNWRACEAAKKTKADDRGTDEKTSEQTILNMISQSSSDTTIAGLMSMSTSTTSAVPSLPVSEESSSNLTSVEMLPGKRWLSSQPSFKLEPTQGHRTSENLALTGVDHSLPQDGSNAFISQKQNSKSVPSAKVSLKEYRAKHAEELAAQKRQLENMEANVKSQYAYAAQNLLSHHDSHSSVILKMPIEGSENPERPFLEKADKTALKMRIPVAGGDKAASSKPEEIKMRIKVHAAADKHNSVEDSVTKSREHKEKHKTHPSNHHHHHNHHSHKHSHSQLPVGTGNKRPGDPKHSSQTSNLAHKTYSLSSSFSSSSSTRKRGPSEETGGAVFDHPAKIAKSTKSSSLNFSFPSLPTMGQMPGHSSDTSGLSFSQPSCKTRVPHSKLDKGPTGANGHNTTQTIDYQDTVNMLHSLLSAQGVQPTQPTAFEFVRPYSDYLNPRSGGISSRSGNTDKPRPPPLPSEPPPPLPPLPK

SEQ ID NO: 42 - protein, 591 aa, Homo sapiens
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPATTARGGPGKAGSRGRFAGHSEAGGGSGDRRRAGPEKRPKSSREGSGGPQESSRDKRPLSGPDVGTPQPAGLASGAKLAAGRPFNTYPRADTDHPSRGAQGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 43 - protein, 424 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 44 - protein, 209 aa, Homo sapiens
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIV

SEQ ID NO: 45 - protein, 1073 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 46 - protein, 421 aa, Homo sapiens
MASSSVPPATVSAATAGPGPGFGFASKTKKKHFVQQKVKVFRAADPLVGVFLWGVAHSINELSQVPPPVMLLPDDFKASSKIKVNNHLFHRENLPSHFKFKEYCPQVFRNLRDRFGIDDQDYLVSLTRNPPSESEGSDGRFLISYDRTLVIKEVSSEDIADMHSNLSNYHQYIVKCHGNTLLPQFLGMYRVSVDNEDSYMLVMRNMFSHRLPVHRKYDLKGSLVSREASDKEKVKELPTLRDMDFLNKNQKVYIGEEEKKIFLEKLKRDVEFLVQLKIMDYSLLLGIHDIIRGSEPEEEAPVREDESEVDGDCSLTGPPALVGSYGTSPEGIGGYIHSHRPLGPGEFESFIDVYAIRSAEGAPQKEVYFMGLIDILTQYDAKKKAAHAAKTVKHGAGAEISTVHPEQYAKRFLDFITNIFA

SEQ ID NO: 47 - protein, 619 aa, Homo sapiens
MPDPAAHLPFFYGSISRAEAEEHLKLAGMADGLFLLRQCLRSLGGYVLSLVHDVRFHHFPIERQLNGTYAIAGGKAHCGPAELCEFYSRDPDGLPCNLRKPCNRPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 48 - protein, 418 aa, Homo sapiens [sequence omitted]

SEQ ID NO: 49 - protein, 279 aa, Homo sapiens [sequence omitted]

SEQ ID NO: 50 - protein, 631 aa, Homo sapiens
MTSANKAIELQLQVKQNAEELQDFMRDLENWEKDIKQKDMELRRQNGVPEENLPPIRNGNFRKKKKGKAKESSKKTREENTKNRIKSYDYEAWAKLDVDRILDELDKDDSTHESLSQESESEEDGIHVDSQKALVLKEKGNKYFKQGKYDEAIDCYTKGMDADPYNPVLPTNRASAYFRLKKFAVAESDCNLAVALNRSYTKAYSRRGAARFALQKLEEAKKDYERVLELEPNNFEATNELRKISQALASKENSYPKEADIVIKSTEGERKQIEAQQNKQQAISEKDRGNGFFKEGKYERAIECYTRGIAADGANALLPANRAMAYLKIQKYEEAEKDCTQAILLDGSYSKAFARRGTARTFLGKLNEAKQDFETVLLLEPGNKQAVTELSKIKKKPLKKVIIEETGNLIQTIDVPDSTTAAAPENNPINLANVIAATGTTSKKNSSQDDLFPTSDTPRAKVLKIEEVSDTSSLQPQASLKQDVCQSYSEKMPIEIEQKPAQFATTVLPPIPANSFQLESDFRQLKSSPDMLYQYLKQIEPSLYPKLFQKNLDPDVFNQIVKILHDFYIEKEKPLLIFEILQRLSELKRFDMAVMFMSETEKKIARALFNHIDKSGLKDSSVEELKKRYGG

SEQ ID NO: 51 - protein, 362 aa, Homo sapiens
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 52 - protein, 181 aa, Homo sapiens
MAGSREVVAMDCEMVGLGPHRESGLARCSLVNVHGAVLYDKFIRPEGEITDYRTRVSGVTPQHMVGATPFAVARLEILQLLKGKLVVGHDLKHDFQALKEDMSGYTIYDTSTDRLLWREAKLDHCRRVSLRVLSERLLHKSIQNSLLGHSSVEDARATMELYQISQRIRARRGLPRLAVSD

SEQ ID NO: 53 - protein, 85 aa, Homo sapiens
MEFDLGAALEPTSQKPGVGAGHGGDPKLSPHKVQGRSEAGAGPGPKASNFRGLGKGRRLTAAPPSSKDTTALPTPAAAPAIRTRM

SEQ ID NO: 54 - protein, 475 aa, Homo sapiens [sequence omitted]

SEQ ID NO: 55 - protein, 454 aa, Homo sapiens
MAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPEGPAETDPEVTPQLSSPAPLCLTLQERLLAFERDRVTIPAAQVALAKQLAGDIALELQAYFRSKFPELPFGAFVPGGPLYDGLQAGAADHVRLLVPLVLEPGLWSLVPGVDTVARDPRCWAVRRTQLEFCPRGSSPWDRFLVGGYLSSRVLLELLRKALAASVNWPAIGSLLGCLIRPSMASEELLLEVQHERLELTVAVLVAVPGVDADDRLLLAWPLEGLAGNLWLQDLYPVEAARLRALDDHDAGTRRRLLLLLCAVCRGCSALGQLGRGHLTQVVLRLGEDNVDWTEEALGERFLQALELLIGSLEQASLPCHFNPSVNLFSSLREEEIDDIGYALYSGLQEPEGLL

SEQ ID NO: 56 - protein, 282 aa, Homo sapiens
MAVPETRPNHTIYINNLNEKIKKDELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAARDALQGFKITQNNAMKISFAKK

SEQ ID NO: 57 - protein, 115 aa, Homo sapiens
MRYVASYLLAALGGNSSPSAKDIKKILDSVGIEADDDRLNKVISELNGKNIEDVIAQGIGKLASVPAGGAVAVSAAPGSAAPAAGSAPAAAEEKKDEKKEESEESDDDMGFGLFD

SEQ ID NO: 58 - protein, 614 aa, Homo sapiens
CMQVGCNKVYTSTSDVMTHENFHKKNTQLINDGFQRFRATEDCGTADCQFYGQKTTHFHCRRPGCTFTFKNKCDIEKHKSYHIKDDAYAKDGFKKFYKYEECKYEGCVYSKATNHFHCIRAGCGFTFTSTSQMTSHKRKHERRHIRSSGALGLPPSLLGAKDTEHEESSNDDLVDFSALSSKNSSLSASPTSQQSSASLAAATAATEAGPSATKPPNSKISGLLPQGLPGSIPLALALSNSGLPTPTPYFPILAGRGSTSLPVGTPSLLGAVSSGSAASATPDTPTLVASGAGDSAPVAAASVPAPPASIMERISASKGLISPMMARLAAAALKPSATFDPGSGQQVTPARFPPAQVKPEPGESTGAPGPHEASQDRSLDLTVKEPSNESNGHAVPANSSLLSSLMNKMSQGNPGLGSLLNIKAEAEGSPAAEPSPFLGKAVKALVQEKLAEPWKVYLRRFGTKDFCDGQCDFLHKAHFHCVVEECGALFSTLDGAIKHANFHFRTEGGAAKGNTEAAFPASAAETKPPMAPSSPPVPPVTTATVSSLEGPAPSPASVPSTPTLLAWKQLASTIPQMPQIPASVPHLPASPLATTSLENAKPQVKPGFLQFQEK

SEQ ID NO: 59 - protein, 437 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 60 - protein, 159 aa, Homo sapiens
MPKFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 61 - protein, 181 aa, Homo sapiens
MESKEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 62 - protein, 78 aa, Homo sapiens; identical to SEQ ID NO: 35

SEQ ID NO: 63 - protein, 471 aa, Homo sapiens
MELGLRWVFLVAILEGVQCEVQLVESGGGLVKPGGSLRLSCAASGFTFSSYSMNWVRQAPGKGLEWVSSMSSSSSYIYYADSVKGRFTISRDNAKNSLYLQMNSLRAEDTAVYYCARDLRQLTSYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 326 aa, Homo sapiens
MPPMPVASVAPSASMPGSHLPPLYLDGHVFASQPRLVPQTIPQQQSYQQAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRPSSASPSGKPSGSAVNMGSVQGHYVQQAKQRVDEKPSLGAVKLQEAPSAASQMKRTGAIKPRAVKVEESKA

SEQ ID NO: 65 - protein, 536 aa, Homo sapiens
MTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 66 - protein, 268 aa, Homo sapiens
MAVNVYSTSVTSDNLSRHDMLAWINESLQLNLTKIEQLCSGAAYCQFMDMLFPGSIALKKVKFQAKLEHEYIQNFKILQAGFKRMGVDKIIPVDKLVKGKFQDNFEFVQWFKKFFDANYDGKDYDPVAARQGQETAVAPSLVAPALNKPKKPLTSSSAAPQRPISTQRTAAAPKAGPGVVRKNPGVGNGDDEAAELMQQVNVLKLTVEDLEKERDFYFGKLRNIELICQENEGENDPVLQRIVDILYATDEGFVIPDEGGPQEEQEEY

SEQ ID NO: 67 - protein, 254 aa, Homo sapiens
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFSQAKLLAGAVKHKSSESGNSVKRLKPDPEPDDKNQEPSSCKSLGNTSLSGPSIHCPSAAVCIGILPGLGAYSGSSDSESSSDSEGTINATGKIVSSIFRTNTFLEAP

SEQ ID NO: 68 - protein, 466 aa, Homo sapiens
MGWITEDLIRRNAEHNDCVIFSLEELSLHQQEIERLEHIDKWCRDLKILYLQNNLIGKIENVSKLKKLEYLNLALNNIEKIENLEGCEELAKLDLTVNFIGELSSIKNLQHNIHLKELFLMGNPCASFDHYREFVVATLPQLKWLDGKEIEPSERIKALQDYSVIEPQIREQEKDHCLKRAKLKEEAQRKHQEEDKNEDKRSNAGFDGRWYTDINATLSSLESKDHLQAPDTEEHNTKKLDNSEDDLEFWNKPCLFTPESRLETLRHMEKQRKKQEKLSEKKKKVKPPRTLITEDGKALNVNEPKIDFSLKDNEKQIILDLAVYRYMDTSLIDVDVQPTYVRVMIKGKPFQLVLPAEVKPDSSSAKRSQTTGHLVICMPKVGEVITGGQRAFKSMKTTSDRSREQTNTRSKHMEKLEVDPSKHSFPDVTNIVQEKKHTPRRRPEPKIIPSEEDPTFEDNPEVPPLI

SEQ ID NO: 69 - protein, 545 aa, Homo sapiens
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARLLQTSNITKSEQKKNPQAVLDVLEFYNSKKTSNSQKYMSFTDKSAEDYNSSNALNVKAVSETPAVPPVSEDEDDDDDDATPPPVIAPRPEHTKSVYTRSVIEPLPVTPTRDVATSPISPTENNTTPPDALTRNTEKQKKKPKMSDEEILEKLRSIVSVGDPKKKYTRFEKIGQGASGTVYTAMDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQHQFLKIAKPLSSLTPLIAAAKEATKNNH

SEQ ID NO: 70 - protein, 145 aa, Homo sapiens
MWSFLPGAESVSMGPVPGVSSLGACWTHDQDSGRAEDRPQAPRITQYTWVLSFLFTEKPQTRSTSPISHQGQPQTTRALSLRQPQHPSAPASGRPRPPHSSGPDLAEAAPVVDQASQAAGRASSGLGLWEQASVSQGFRNAAFEA

SEQ ID NO: 71 - protein, 426 aa, Homo sapiens
MAHLRGFANQHSRVDPEELFTKLDRIGKGSFGEVYKGIDNHTKEVVAIKIIDLEEAEDEIEDIQQEITVLSQCDSPYITRYFGSYLKSTKLWIIMEYLGGGSALDLLKPGPLEETYIATILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKPFKEFVEACLNKDPRFRPTAKELLKHKFITRYTKKTSFLTELIDRYKRWKSEGHGEESSSEDSDIDGEAEDGEQGPIWTFPPTIRPSPHSKLHKGTALHSSQKPAEPVKRQPRSQCLSTLVRPVFGELKEKHKQSGGSVGALEELENAFSLAEESCPGISDKLMVHLVERVQRFSHNRNHLTSTR

SEQ ID NO: 72 - protein, 194 aa, Homo sapiens
MAKQKRKVPEVTEKKNKKLKKASAEGPLLGPEAAPSGEGAGSKGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 73 - protein, 1146 aa, Homo sapiens
MVLGTVLLPPNSYGRDQDTSLCCLCTEASESALPDLTEALHRPYGCDVEPQALNEAIRWSSKENLLGATESDPNLFVALYDFVASGDNTLSITKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRACWKWSPADRPSFAETHQAFETMFHDSSISEEVAEELGRAASSSSVVPYLPRLPILPSKTRTLKKQVENKENIEGAQDATENSASSLAPGFIRGAQASSGSPALPRKQRDKSPSSLLEDAKETCFTRDRKGGFFSSFMKKRNAPTPPKRSSSFREMENQPHKKYELTGNFSSVASLQHADGFSFTPAQQEANLVPPKCYGGSFAQRNLCNDDGGGGGGSGTAGGGWSGITGFFTPRLIKKTLGLRAGKPTASDDTSKPFPRSNSTSSMSSGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 74 - protein, 335 aa, Homo sapiens
MVRPVRHKKPVNYSQFDHSDSDDDFVSATVPLNKKSRTAPKELKQDKPKPNLNNLRKEEIPVQEKTPKKRMALDDKLYQRDLEVALALSVKELPTVTTNVQNSQDKSIEKHGSSKIETMNKSPHISNCSVASDYLDLDKITVEDDVGGVQGKRKAASKAAAQQRKILLEGSDGDSANDTEPDFAPGEDSEDDSDFCESEDNDEDFSMRKSKVKEIKKKEVKVKSPVEKKEKKSKSKCNALVTSVDSAPAAVKSESQSLPKKVSLSSDTTRKPLEIRSPSAESKKPKWVPPAASGGSRSSSSPLVVVSVKSPNQSLRLGLSRLARVKPLHPNATST

SEQ ID NO: 75 - protein, 558 aa, Homo sapiens
MAIPGRQYGLILPKKTQQLHPVLQKPSVFGNDSDDDDETSVSESLQREAAKKQAMKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 76 - protein, 1242 aa, Homo sapiens
MASPPESDGFSDVRKVGYLRKPKSMHKRFFVLRAASEAGGPARLEYYENEKKWRHKSSAPKRSIPLESCFNINKRADSKNKHLVALYTRDEHFAIAADSEAEQDSWYQALLQLHNRAKGHHDGAAALGAGGGGGSCSGSSGLGEAGEDLSYGDVPPGPAFKEVWQVILKPKGLGQTKNLIGIYRLCLTSKTISFVKLNSEAAAVVLQLMNIRRCGHSENFFFIEVGRSAVTGPGEFWMQVDDSVVAQNMHETILEAMRAMSDEFRPRSKSQSSSNCSNPISVPLRRHHLNNPPPSQVGLTRRSRTESITATSPASMVGGKPGSFRVRASSDGEGTMSRPASVDGSPVSPSTNRTHAHRHRGSARLHPPLNHSRSIPMPASRCSPSATSPVSLSSSSTSGHGSTSDCLFPRRSSASVSGSPSDGGFISSDEYGSSPCDFRSSFRSVTPDSLGHTPPARGEEELSNYICMGGKGPSTLTAPNGHYILSRGGNGHRCTPGTGLGTSPALAGDEAASAADLDNRFRKRTHSAGTSPTITHQKTPSQSSVASIEEYTEMMPAYPPGGGSGGRLPGHRHSAFVPTRSYPEEGLEMHPLERRGGHHRPDSSTLHTDDGYMPMSPGVAPVPSGRKGSGDYMPMSPKSVSAPQQIINPIRRHPQRVDPNGYMMMSPSGGCSPDIGGGPSSSSSSSNAVPSGTSYGKLWTNGVGGHHSHVLPHPKPPVESSGGKLLPCTGDYMNMSPVGDSNTSSPSDCYYGPEDPQHKPVLSYYSLPRSFKHTQRPGEPEEGARHQHLRLSTSSGRLLYAATADDSSSSTSSDSLGGGYCGARLEPSLPHPHHQVLQPHLPRKVDTAAQTNSRLARPTRLSLGDPKASTLPRAREQQQQQQPLLHPPEPKSPGEYVNIEFGSDQSGYLSGPVAFHSSPSVRCPSQLQPAPREEETGTEEYMKMDLGPGRRAAWQESTGVEMGRLGPAPPGAASICRPTRAVPSSRGDYMTMQMSCPRQSYVDTSPAAPVSYADMRTGIAAEEVSLPRATMAAASSSSAASASPTGPQGAAELAAHSSLLGGPQGPGGMSAFTRVNLSPNRNQSAKVIRADPQGCRRRHSSETFSSTPSATRVGNTVPFGAGAAVGGGGGSSSSSEDVKRHSSASFENVWLRPGELGGAPKEPAKLCGAAGGLENGLNYIDLDLVKDFKQCPQECTPEPQPPPPPPPHQPLGSGESSSTRRSSEDLSAYASISFQKQPEDRQ

SEQ ID NO: 77 - protein, 1106 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 78 - protein, 486 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 79 - protein, 402 aa, Homo sapiens [sequence omitted]

SEQ ID NO: 80 - protein, 293 aa, Homo sapiens; identical to SEQ ID NO: 4

SEQ ID NO: 81 - protein, 424 aa, Homo sapiens
MAAGPISERNQDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 82 - protein, 806 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 83 - protein, 553 aa, Homo sapiens [sequence omitted]

SEQ ID NO: 84 - protein, 204 aa, Homo sapiens
MEAAGSPAATETGKYIASTQRPDGTWRKQRRVKEGYVPQEEVPVYENKYVKFFKSKPELPPGLSPEATAPVTPSRPEGGEPGLSKTAKRNLKRKEKRRQQQEKGEAEALSRTLDKVSLEETAQLPSAPQGSRAAPTAASDQPDSAATTEKAKKIKNLKKKLRQVEELQQRIQAGEVSQPSKEQLEKLARRRALEEELEDLELGL

SEQ ID NO: 85 - protein, 354 aa, Homo sapiens
MCGRTSCHLPRDVLTRACAYQDRRGQQRLPEWRDPDKYCPSYNKSPQSNSPVLLSRLHFDKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 86 - protein, 468 aa, Homo sapiens
MAKRNAEKELTDRNWDQEDEAEEVGTFSMASEEVLKNRAIKKAKRRNVGFESDTGGAFKGFKGLVVPSGGGRFSGFGSGAGGKPLEGLSNGNNITSAPPFASAKAAADPKVAFGSLAANGPTTLVDKVSNPKTNGDSQQPSSSGLASSKACVGNAYHKQLAALNCSVRDWIVKHVNTNPLCDLTPIFKDYEKYLANIEQQHGNSGRNSESESNKVAAETQSPSLFGSTKLQQESTFLFHGNKTEDTPDKKMEVASEKKTDPSSLGATSASFNFGKKVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 87 - protein, 1130 aa, Homo sapiens
MLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 88 - protein, 209 aa, Homo sapiens; identical to SEQ ID NO: 44

SEQ ID NO: 89 - protein, 505 aa, Homo sapiens
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 90 - protein, 545 aa, Homo sapiens; identical to SEQ ID NO: 69

SEQ ID NO: 91 - protein, 586 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLETESGHVTQSDLELLLSSDPPASASQSAGIRGVRHHPRPVCSLKCVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 92 - protein, 3267 aa, Homo sapiens
MQKARGTRGEDAGTRAPPSPGVPPKRAKVGAGGGAPVAVAGAPVFLRPLKNAAVCAGSDVRLRVVVSGTPQPSLRWFRDGQLLPAPAPEPSCLWLRRCGAQDAGVYSCMAQNERGRASCEAVLTVLEVGDSETAEDDISDVQGTQRLELRDDGAFSTPTGGSDTLVGTSLDTPPTSVTGTSEEQVSWWGSGQTVLEQEAGSGGGTRRLPGSPRQAQATGAGPRHLGVEPLVRASRANLVGASWGSEDSLSVASDLYGSAFSLYRGRALSIHVSVPQSGLRREEPDLQPQLASEAPRRPAQPPPSKSALLPPPSPRVGKRSPPGPPAQPAATPTSPHRRTQEPVLPEDTTTEEKRGKKSKSSGPSLAGTAESRPQTPLSEASGRLSALGRSPRLVRAGSRILDKLQFFEERRRSLERSDSPPAPLRPWVPLRKARSLEQPKSERGAPWGTPGASQEELRAPGSVAERRRLFQQKAASLDERTRQRSPASDLELRFAQELGRIRRSTSREELVRSHESLRATLQRAPSPREPGEPPLFSRPSTPKTSRAVSPAAAQPPSPSSAEKPGDEPGRPRSRGPAGRTEPGEGPQQEVRRRDQFPLTRSRAIQECRSPVPPPAADPPEARTKAPPGRKREPPAQAVRFLPWATPGLEGAAVPQTLEKNRAGPEAEKRLRRGPEEDGPWGPWDRRGARSQGKGRRARPTSPELESSDDSYVSAGEEPLEAPVFEIPLQNVVVAPGADVLLKCIITANPPPQVSWHKDGSALRSEGRLLLRAEGERHTLLLREARAADAGSYMATATNELGQATCAASLTVRPGGSTSPFSSPITSDEEYLSPPEEFPEPGETWPRTPTMKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRAHPESRSLAVLAPLQDVDVGAGEMALFECLVAGPTDVEVDWLCRGRLLQPALLKCKMHFDGRKCKLLLTSVHEDDSGVYTCKLSTAKDELTCSARLTVRPSLAPLFTRLLEDVEVLEGRAARFDCKISGTPPPVVTWTHFGCPMEESENLRLRQDGGLHSLHIAHVGSEDEGLYAVSAVNTHGQAHCSAQLYVEEPRTAASGPSSKLEKMPSIPEEPEQGELERLSIPDFLRPLQDLEVGLAKEAMLECQVTGLPYPTISWFHNGHRIQSSDDRRMTQYRDVHRLVFPAVGPQHAGVYKSVIANKLGKAACYAHLYVTDVVPGPPDGAPQVVAVTGRMVTLTWNPPRSLDMAIDPDSLTYTVQHQVLGSDQWTALVTGLREPGWAATGLRKGVQHIFRVLSTTVKSSSKPSPPSEPVQLLEHGPTLEEAPAMLDKPDIVYVVEGQPASVTVTFNHVEAQVVWRSCRGALLEARAGVYELSQPDDDQYCLRICRVSRRDMGALTCTARNRHGTQTCSVTLELAEAPRFESIMEDVEVGAGETARFAVVVEGKPLPDIMWYKDEVLLTESSHVSFVYEENECSLVVLSTGAQDGGVYTCTAQNLAGEVSCKAELAVHSAQTAMEVEGVGEDEDHRGRRLSDFYDIHQEIGRGAFSYLRRIVERSSGLEFAAKFIPSQAKPKASARREARLLARLQHDCVLYFHEAFERRRGLVIVTELCTEELLERIARKPTVCESEIRAYMRQVLEGIHYLHQSHVLHLDVKPENLLVWDGAAGEQQVRICDFGNAQELTPGEPQYCQYGTPEFVAPEIVNQSPVSGVTDIWPVGVVAFLCLTGISPFVGENDRTTLMNIRNYNVAFEETTFLSLSREARGFLIKVLVQDRLRPTAEETLEHPWFKTQAKGAEVSTDHLKLFLSRRRWQRSQISYKCHLVLRPIPELLRAPPERVWVTMPRRPPPSGGLSSSSDSEEEELEELPSVPRPLQPEFSGSRVSLTDIPTEDEALGTPETGAATPMDWQEQGRAPSQDQEAPSPEALPSPGQEPAAGASPRRGELRRGSSAESALPRAGPRELGRGLHKAASVELPQRRSPSPGATRLARGGLGEGEYAQRLQALRQRLLRGGPEDGKVSGLRGPLLESLGGRARDPRMARAASSEAAPHHQPPLENRGLQKSSSFSQGEAEPRGRHRRAGAPLEIPVARLGARRLQESPSLSALSEAQPSSPARPSAPKPSTPKSAEPSATTPSDAPQPPAPQPAQDKAPEPRPEPVRASKPAPPPQALQTLALPLTPYAQIIQSLQLSGHAQGPSQGPAAPPSEPKPHAAVFARVASPPPGAPEKRVPSAGGPPVLAEKARVPTVPPRPGSSLSSSIENLESEAVFEAKFKRSRESPLSLGLRLLSRSRSEERGPFRGAEEEDGIYRPSPAGTPLELVRRPERSRSVQDLRAVGEPGLVRRLSLSLSQRLRRTPPAQRHPAWEARGGDGESSEGGSSARGSPVLAMRRRLSFTLERLSSRLQRSGSSEDSGGASGRSTPLFGRLRRATSEGESLRRLGLPHNQLAAQAGATTPSAESLGSEASATSGSSAPGESRSRLRWGFSRPRKDKGLSPPNLSASVQEELGHQYVRSESDFPPVFHIKLKDQVLLEGEAATLLCLPAACPAPHISWMKDKKSLRSEPSVIIVSCKDGRQLLSIPRAGKRHAGLYECSATNVLGSITSSCTVAVARVPGKLAPPEVPQTYQDTALVLWKPGDSRAPCTYTLERRVDGESVWHPVSSGIPDCYYNVTHLPVGVTVRFRVACANRAGQGPFSNSSEKVFVRGTQDSSAVPSAAHQEAPVTSRPARARPPDSPTSLAPPLAPAAPTPPSVTVSPSSPPTPPSQALSSLKAVGPPPQTPPRRHRGLQAARPAEPTLPSTHVTPSEPKPFVLDTGTPIPASTPQGVKPVSSSTPVYVVTSFVSAPPAPEPPAPEPPPEPTKVTVQSLSPAKEVVSSPGSSPRSSPRPEGTTLRQGPPQKPYTFLEEKARGRFGVVRACRENATGRTFVAKIVPYAAEGKRRVLQEYEVLRTLHHERIMSLHEAYITPRYLVLIAESCGNRELLCGLSDRFRYSEDDVATYMVQLLQGLDYLHGHHVLHLDIKPDNLLLAPDNALKIVDFGSAQPYNPQALRPLGHRTGTLEFMAPEMVKGEPIGSATDIWGAGVLTYIMLSGRSPFYEPDPQETEARIVGGRFDAFQLYPNTSQSATLFLRKVLSVHPWSRPSLQDCLAHPWLQDAYLMKLRRQTLTFTTNRLKEFLGEQRRRRAEAATRHKVLLRSYPGGP

SEQ ID NO: 93 - protein, 393 aa, Homo sapiens [sequence omitted]

SEQ ID NO: 94 - protein, 673 aa, Homo sapiens
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKACGRNAENFDRFFTRHPPVLTPPDQEVIRNIDQSEFEGFSFVNSEFLKPEVKS

SEQ ID NO: 95 - protein, 726 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNAYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDGEKETAPEEPGSPAKSAPASPVQSPAKEAETKSPLVSPSKSLEEGTKKTETSKAATTEPETTQPEGVVVNGREEEQTAEEILSKGLSQMTTSADTDVDTSKDKTESVTSGPMSPEGSPSKSPSKKKKKFRTPSFLKKSKKKEKVES

SEQ ID NO: 96 - protein, 603 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 97 - protein, 556 aa, Homo sapiens
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 98 - protein, 506 aa, Homo sapiens
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKTNPSRIRIALGNEASTVQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 99 - protein, 619 aa, Homo sapiens; identical to SEQ ID NO: 47

SEQ ID NO: 100 - protein, 548 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSGKALCSWSIC

SEQ ID NO: 101 - protein, 576 aa, Homo sapiens
MAASETVRLRLQFDYPPPATPHCTAFWLLVDLNRCRVVTDLISLIRQRFGFSSGAFLGLYLEGGLLPPAESARLVRDNDCLRVKLEERGVAENSVVISNGDINLSLRKAKKRAFQLEEGEETEPDCKYSKKHWKSRENNNNNEKVLDLEPKAVTDQTVSKKNKRKNKATCGTVGDDNEEAKRKSPKKKEKCEYKKKAKNPKSPKVQAVKDWANQRCSSPKGSARNSLVKAKRKGSVSVCSKESPSSSSESESCDESISDGPSKVTLEARNSSEKLPTELSKEEPSTKNTTADKLAIKLGFSLTPSKGKTSGTTSSSSDSSAESDDQCLMSSSTPECAAGFLKTVGLFAGRGRPGPGLSSQTAGAAGWRRSGSNGGGQAPGASPSVSLPASLGRGWGREENLFSWKGAKGRGMRGRGRGRGHPVSCVVNRSTDNQRQQQLNDVVKNSSTIIQNPVETPKKDYSLLPLLAAAPQVGEKIAFKLLELTSSYSPDVSDYKEGRILSHNPETQQVDIEILSSLPALREPGKFDLVYHNENGAEVVEYAVTQESKITVFWKELIDPRLIIESPSNTSSTEPA

SEQ ID NO: 102 - protein, 424 aa, Homo sapiens; identical to SEQ ID NO: 43

SEQ ID NO: 103 - protein, 697 aa, Homo sapiens
MAGLGPGVGDSEGGPRPLFCRKGALRQKVVHEVKSHKFTARFFKQPTFCSHCTDFIWGIGKQGLQCQVCSFVVHRRCHEFVTFECPGAGKGPQTDDPRNKHKFRLHSYSSPTFCDHCGSLLYGLVHQGMKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETFVFNLKPGDVERRLSVEVWDWDRTSRNDFMGAMSFGVSELLKAPVDGWYKLLNQEEGEYYNVPVADADNCSLLQKFEACNYPLELYERVRMGPSSSPIPSPSPSPTDPKRCFFGASPGRLHISDFSFLMVLGKGSFGKVMLAERRGSDELYAIKILKKDVIVQDDDVDCTLVEKRVLALGGRGPGGRPHFLTQLHSTFQTPDRLYFVMEYVTGGDLMYHIQQLGKFKEPHAAFYAAEIAIGLFFLHNQGIIYRDLKLDNVMLDAEGHIKITDFGMCKENVFPGTTTRTFCGTPDYIAPEIIAYQPYGKSVDWWSFGVLLYEMLAGQPPFDGEDEEELFQAIMEQTVTYPKSLSREAVAICKGFLTKHPGKRLGSGPDGEPTIRAHGFFRWIDWERLERLEIPPPFRPRPCGRSGENFDKFFTRAAPALTPPDRLVLASIDQADFQGFTYVNPDFVHPDARSPTSPVPVPVM

SEQ ID NO: 104 - protein, 441 aa, Homo sapiens
MKKFFQEFKADIKFKSAGPGQKLKESVGEKAHKEKPNQPAPRPPRQGPTNEAQMAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 105 - protein, 737 aa, Homo sapiens
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYVIIDLSGSSGEAPKDNEERVFRERMRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIKTKRDVNNFDQDFTREEPVLTLVDEAIVKQINQEEFKGFSYFGEDLMP

SEQ ID NO: 106 - protein, 183 aa, Homo sapiens
MSSPSPGKRRMDTDVVKLIESKHEVTILGGLNEFVVKFYGPQGTPYEGGVWKVRVDLPDKYPFKSPSIGFMNKIFHPNIDEASGTVCLDVINQTWTALYDLTNIFESFLPQLLAYPNPIDPLNGDAAAMYLHRPEEYKQKIKEYIQKYATEEALKEQEEGTGDSSSESSMSDFSEDEAQDMEL

SEQ ID NO: 107 - protein, 1146 aa, Homo sapiens; identical to SEQ ID NO: 73

SEQ ID NO: 108 - protein, 365 aa, Homo sapiens
MNREDRNVLRMKERERRNQEIQQGEDAFPPSSPLFAEPYKVTSKEDKLSSRIQSMLGNYDEMKDFIGDRSIPKLVAIPKPTVPPSADEKSNPNFFEQRHGGSHQSSKWTPVGPAPSTSQSQKRSSGLQSGHSSQRTSAGSSSGTNSSGQRHDRESYNNSGSSSRKKGQHGSEHSKSRSSSPGKPQAVSSLNSSHSRSHGNDHHSKEHQRSKSPRDPDANWDSPSRVPFSSGQHSTQSFPPSLMSKSNSMLQKPTAYVRPMDGQESMEPKLSSEHYSSQSHGNSMTELKPSSKAHLTKLKIPSQPLDASASGDVSCVDEILKEMTHSWPPPLTAIHTPCKTEPSKFPFPTKESQQSNFGTGEQRLK

SEQ ID NO: 109 - protein, 726 aa, Homo sapiens; identical to SEQ ID NO: 41

SEQ ID NO: 110 - protein, 258 aa, Homo sapiens
MTHDKSWRRCSISGSTKCRCGSRIAGPNALGSGGSRSSSSSSRSILSSSILSSSIPSSSSSSSSPSSSHSSSSPSSSHSSSSPSSSSSTSSPSSSSSSSSSSSPSSSNSSSSSSSSSPSSSSSSSSSSPSSSSSSPSSSSSSSSSSPSSSSSSPSSSSSSSSSSSSSPSSSSPSSSGSSPSSSNSSPSSSSSSPSSSSSSPSPRSSSPSSSSSSTSSPSTSSPSSSSPSSSSPSSSCPSAALGRRPQSPQSSHCAPFP

SEQ ID NO: 111 - protein, 358 aa, Homo sapiens
MDDATVLRKKGYIVGINLGKGSYAKVKSAYSERLKFNVAVKIIDRKKTPTDFVERFLPREMDILATVNHGSIIKTYEIFETSDGRIYIIMELGVQGDLLEFIKCQGALHEDVARKMFRQLSSAVKYCHDLDIVHRDLKCENLLLDKDFNIKLSDFGFSKRCLRDSNGRIILSKTFCGSAAYAAPEVLQSIPYQPKVYDIWSLGVILYIMVCGSMPYDDSDIRKMLRIQKEHRVDFPRSKNLTCECKDLIYRMLQPDVSQRLHIDEILSHSWLQPPKPKATSSASFKREGEGKYRAECKLDTKTGLRPDHRPDHKLGAKTQHRLLVVPENENRMEDRLAETSRAKDHHISGAEVGKAST

SEQ ID NO: 112 - protein, 661 aa, Homo sapiens
MEGAAAPVAGDRPDLGLGAPGSPREAVAGATAALEPRKPHGVKRHHHKHNLKHRYELQETLGKGTYGKVKRATERFSGRVVAIKSIRKDKIKDEQDMVHIRREIEIMSSLNHPHIISIYEVFENKDKIVIIMEYASKGELYDYISERRRLSERETRHFFRQIVSAVHYCHKNGVVHRDLKLENILLDDNCNIKIADFGLSNLYQKDKFLQTFCGSPLYASPEIVNGRPYRGPEVDSWALGVLLYTLVYGTMPFDGFDHKNLIRQISSGEYREPTQPSDARGLIRWMLMVNPDRRATIEDIANHWWVNWGYKSSVCDCDALHDSESPLLARIIDWHHRSTGLQADTEAKMKGLAKPTTSEVMLERQRSLKKSKKENDFAQSGQDAVPESPSKLSSKRPKGILKKRSNSEHRSHSTGFIEGVVGPALPSTFKMEQDLCRTGVLLPSSPEAEVPGKLSPKQSATMPKKGILKKTQQRESGYYSSPERSESSELLDSNDVMGSSIPSPSPPDPARVTSHSLSCRRKGILKHSSKYSAGTMDPALVSPEMPTLESLSEPGVPAEGLSRSYSRPSSVISDDSVLSSDSFDLLDLQENRPARQRIRSCVSAENFLQIQDFEGLQNRPRPQYLKRYRNRLADSSFSLLTDMDDVTQVYKQALEICSKLN

SEQ ID NO: 113 - protein, 724 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 114 - protein, 885 aa, Homo sapiens; identical to SEQ ID NO: 36

SEQ ID NO: 115 - protein, 297 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 116 - protein, 466 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 117 - protein, 298 aa, Homo sapiens
MVTPALQMKKPKQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 118 - protein, 581 aa, Homo sapiens [sequence omitted]

SEQ ID NO: 119 - protein, 370 aa, Homo sapiens
MSHPSPQAKPSNPSNPRVFFDVDIGGERVGRIVLELFADIVPKTAENFRALCTGEKGIGHTTGKPLHFKGCPFHRIIKKFMIQGGDFSNQNGTGGESIYGEKFEDENFHYKHDREGLLSMANAGRNTNGSQFFITTVPTPHLDGKHVVFGQVIKGIGVARILENVEVKGEKPAKLCVIAECGELKEGDDGGIFPKDGSGDSHPDFPEDADIDLKDVDKILLITEDLKNIGNTFFKSQNWEMAIKKYAEVLRYVDSSKAVIETADRAKLQPIALSCVLNIGACKLKMSNWQGAIDSCLEALELDPSNTKALYRRAQGWQGLKEYDQALADLKKAQGIAPEDKAIQAELLKVKQKIKAQKDKEKAVYAKMFA

SEQ ID NO: 120 - protein, 354 aa, Homo sapiens
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 121 - protein, 365 aa, Homo sapiens
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 122 - protein, 70 aa, Homo sapiens; identical to SEQ ID NO: 33

SEQ ID NO: 123 - protein, 352 aa, Homo sapiens; identical to SEQ ID NO: 1

SEQ ID NO: 124 - protein, 365 aa, Homo sapiens
MAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 125 - protein, 601 aa, Homo sapiens
MPERELWPAGTGSEPVTRVGSCDSMMSSTSTRSGSSDSSYDFLSTEEKECLLFLEETIGSLDTEADSGLSTDESEPATTPRGFRALPITQPTPRGGPEETITQQGRTPRTVTESSSSHPPEPQGLGLRSGSYSLPRNIHIARSQNFRKSTTQASSHNPGEPGRLAPEPEKEQVSQSSQPRQAPASPQEAALDLDVVLIPPPEAFRDTQPEQCREASLPEGPGQQGHTPQLHTPSSSQEREQTPSEAMSQKAKETVSTRYTQPQPPPAGLPQNARAEDAPLSSGEDPNSRLAPLTTPKPRKLPPNIVLKSSRSSFHSDPQHWLSRHTEAAPGDSGLISCSLQEQRKARKEALEKLGLPQDQDEPGLHLSKPTSSIRPKETRAQHLSPAPGLAQPAAPAQASAAIPAAGKALAQAPAPAPGPAQGPLPMKSPAPGNVAASKSMPISIPKAPRANSALTPPKPESGLTLQESNTPGLRQMNFKSNTLERSGVGLSSYLSTEKDASPKTSTSLGKGSFLDKISPSVLRNSRPRPASLGTGKDFAGIQVGKLADLEQEQSSKRLSYQGQSRDKLPRPPCVSVKISPKGVPNEHRREALKKLGLLKE

SEQ ID NO: 126 - protein, 433 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKDSSGTGHFTSGVRVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 127 - protein, 40 aa, Homo sapiens
LRSCQGYKQCNPRPKNLDVGNKDGGSYDLHRGQLWDGWEG

SEQ ID NO: 128 - protein, 637 aa, Homo sapiens
MTKRKKLRTSGEGLCPPKPLKNPRLGDFYGDPQSSMLGCLHHPEEPEGKLGPVPSTQQHGEEPGKAVSSSPDEETGSPCRLLRQPEKEPAPLPPSQNSFGRFVPQFAKSRKTVTRKEEMKDEDRGSGAFSLETIAESSAQSPGCQLLVETLGVPLQEATELGDPTQADSARPEQSSQSPVQAVPGSGDSQPDDPPDRGTGLSASQRASQDHLSEQGADDSKPETDRVPGDGGQKEHLPSIDSEGEKPDRGAPQEGGAQRTAGAGLPGGPQEEGDGVPCTPASAPTSGPAPGLGPASWCLEPGSVAQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQQGIPDTTSELAGQRDHLPHSADQGTWADSLAVELDFLLDSQIQDALDASDFEAPPEQLFPSGNKPGPCWPGPSSHANGDPVAVAKAQPSRLIMGTHRDLEAFKRLNYRKTKLGGKAPLPYPSKGPGNIPRGDPPWREL

SEQ ID NO: 129 - protein, 553 aa, Homo sapiens [sequence omitted]

SEQ ID NO: 130 - protein, 553 aa, Homo sapiens
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 131 - protein, 483 aa, Homo sapiens
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGRDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 132 - protein, 744 aa, Homo sapiens
MEQDPKPPRLRLWALIPWLPRKQRPRISQTSLPVPGPGSGPQRDSDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 133 - protein, 209 aa, Homo sapiens
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 134 - protein, 151 aa, Homo sapiens
MDSAACAAAATPVPALALALAPDLAQAPLALPGLLSPSCLLSSGQEVNGSERGTCLWRPWLSSTNDSPRQMRKLVDLAAGGATAAEVTKAESKFHHPVRLFWPKSRSFDYLYSAGEILLQNFPVQATINLYEDSDSEEEEEDEEQEDEEEK

SEQ ID NO: 135 - protein, 539 aa, Homo sapiens
MWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 136 - protein, 280 aa, Homo sapiens
MATEAPVNIAPPECSTVVSTAVDSLIWQPNSLNMHMIRPKSAKGRTRPSLQKSQGVEVCAHHIPSPPPAIPYELPSSQKPGACAPKSPNQGASDEIPELQQQVPTGASSSLNKYPVLPSINRKNLEEEAVETVAKKASSLQLSSIRALYQDETGTMKTSEEDSRARACAVERKFIVRTKKQGSSRAGNLEEPSDQEPRLLLAVRSPTGQRFVRHFRPTDDLQTIVAVAEQKNKTSYRHCSIETMEVPRRRFSDLTKSLQECRIPHKSVLGISLEDGEGWP

SEQ ID NO: 137 - protein, 666 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKAPRVPDILSSVRRGSGAPEAEGPLPCPSPAPFSPLPAPSPRISDILNSVRRGSGTPEAEGPLSAGPPPCLSPALLGPLSSPSPRISDILNSVRRGSGTPEAEGPSPVGPPPCPSPTIPGPLPTPSRKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 138 - protein, 488 aa, Homo sapiens
MRFHWLPTLSEPFDRNQELETCIRPLWTPSGSACETEHNKSMDMGNQHPSISRLQEIQKEVKSVEQQVIGFSGLSDDKNYKKLERILTKQLFEIDSVDTEGKGDIQQARKRAAQETERLLKELEQNANHPHRIEIQNIFEEAQSLVREKIVPFYNGGNCVTDEFEEGIQDIILRLTHVKTGGKISLRKARYHTLTKICAVQEIIEDCMKKQPSLPLSEDAHPSVAKINFVMCEVNKARGVLIALLMGVNNNETCRHLSCVLSGLIADLDALDVCGRTEIRNYRREVVEDINKLLKYLDLEEEADTTKAFDLRQNHSILKIEKVLKRMREIKNELLQAQNPSELYLSSKTELQGLIGQLDEVSLEKNPCIREARRRAVIEVQTLITYIDLKEALEKRKLFACEEHPSHKAVWNVLGNLSEIQGEVLSFDGNRTDKNYIRLEELLTKQLLALDAVDPQGEEKCKAARKQAVRLAQNILSYLDLKSDEWEY

SEQ ID NO: 139 - protein, 928 aa, Homo sapiens
MGGSASSQLDEGKCAYIRGKTEAAIKNFSPYYSRQYSVAFCNHVRTEVEQQRDLTSQFLKTKPPLAPGTILYEAELSQFSEDIKKWKERYVVVKNDYAVESYENKEAYQRGAAPKCRILPAGGKVLTSEDEYNLLSDRHFPDPLASSEKENTQPFVVLPKEFPVYLWQPFFRHGYFCFHEAADQKRFSALLSDCVRHLNHDYMKQMTFEAQAFLEAVQFFRQEKGHYGSWEMITGDEIQILSNLVMEELLPTLQTDLLPKMKGKKNDRKRTWLGLLEEAYTLVQHQVSEGLSALKEECRALTKGLEGTIRSDMDQIVNSKNYLIGKIKAMVAQPAEKSCLESVQPFLASILEELMGPVSSGFSEVRVLFEKEVNEVSQNFQTTKDSVQLKEHLDRLMNLPLHSVKMEPCYTKVNLLHERLQDLKSRFRFPHIDLVVQRTQNYMQELMENAVFTFEQLLSPHLQGEASKTAVAIEKVKLRVLKQYDYDSSTIRKKIFQEALVQITLPTVQKALASTCKPELQKYEQFIFADHTNMIHVENVYEEILHQILLDETLKVIKEAAILKKHNLFEDNMALPSESVSSLTDLKPPTGSNQASPARRASAILPGVLGSETLSNEVFQESEEEKQPEVPSSLAKGESLSLPGPSPPPDGTEQVIISRVDDPVVNPVATEDTAGLPGTCSSELEFGGTLEDEEPAQEEPEPITASGSLKALRKLLTASVEVPVDSAPVMEEDTNGESHVPQENEEEEEKEPSQAAAIHPDNCEESEVSEREAQPPCPEAHGEELGGFPEVGSPASPPASGGLTEEPLGPMEGELPGEACTLTAHEGRGGKCTEEGDASQQEGCTLGSDPICLSESQVSEEQEEMGGQSSAAQATASVNAEEIKVARIHECQWVVEDAPNPDVLLSHKDDVKEGEGGQESFPELPSEE

SEQ ID NO: 140 - protein, 550 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 141 - protein, 1255 aa, Homo sapiens [sequence omitted]

SEQ ID NO: 142 - protein, 284 aa, Homo sapiens
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDELYAQKLKYKAISEELDHALNDMTSI

SEQ ID NO: 143 - protein, 471 aa, Homo sapiens
MLLNDPDTELVRLLASVCMQVNKDKGRPSHQPPLPHSKVRQPWSIPVLPDDKGGLKSWWNRMSNRFRKLKLMQTLPRGLSSNQPLPFSDEPEPALDSTMRAAPQDKTSRSALPDAAPVTKDNGPGSTRGEKEDTLLTTMLRNGAPLTRLPSDKLKAVIPPFLPPSSFELWSSDRSRTRHNGKADPMKTALPQRASRGHPVGGGGTDTTPVRPVKFPSLPRSPASSANSGNFNHSPHSSGGSSGIGVSRHGGELLNRSGGSIDNVLSQIAAQRKKAAGLLEQKPSHRSSPVGPAPGSSPSELPASPAGGSAPVGKKLETSKRPPSGTSTTSKSTSPTLTPSPSPKGHTAESSVSSSSSHRQSKSSGGSSSGTITDEDELTGILKKLSLEKYQPIFEEQEVDMEAFLTLTDGDLKELGIKTDGSRQQILAAISELNAGKGRERQILQETIHNFHSSFESSASNTRAPGNSPCA

SEQ ID NO: 144 - protein, 1073 aa, Homo sapiens; identical to SEQ ID NO: 45

SEQ ID NO: 145 - protein, 227 aa, Homo sapiens
MEKLFNENEGMPSNQGKIDNEEQPPHEGKPEVACILEDKKLENEGNTENTGKRVEEPLKDKEKPESAGKAKGEGKSERKGKSEMQGGSKTEGKPERGGRAEGEGEPDSEREPESEGEPESETRAAGKRPAEDDIPRKAKRKTNKGLAQYLKQYKEAIHDMNFSNEDMIREFDNMARVEDKRRKSKQKLGAFLWMQRNLQDPFYPRGPREFRGGCRAPRRDTEDIPYV

SEQ ID NO: 146 - protein, 117 aa, Homo sapiens
MDMRVPAQLLGLLLLWLPGAKCDIQMTQSPSTLSASVGDRVTITCRASQSISSWLAWYQQKPGKAPKLLIYDASSLESGVPSRFSGSGSGTEFTLTISSLQPDDFATYYCQQYNSYS

SEQ ID NO: 147 - protein, 284 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESRARQLEEELRTMDQALKSLMASEEEYSTKEDKYEEEIKLLEEKLKEAETRAEFAERSVAKLEKTIDDLEETLASAKEENVEIHQTLDQTLLELNNL

SEQ ID NO: 148 - protein, 460 aa, Homo sapiens
MNKPITPSTYVRCLNVGLIRKLSDFIDPQEGWKKLAVAIKKPSGDDRYNQFHIRRFEALLQTGKSPTSELLFDWGTTNCTVGDLVDLLIQNEFFAPASLLLPDAVPKTANTLPSKEAITVQQKQMPFCDKDRTLMTPVQNLEQSYMPPDSSSPENKSLEVSDTRFHSFSFYELKNVTNNFDERPISVGGNKMGEGGFGVVYKGYVNNTTVAVKKLAAMVDITTEELKQQFDQEIKVMAKCQHENLVELLGFSSDGDDLCLVYVYMPNGSLLDRLSCLDGTPPLSWHMRCKIAQGAANGINFLHENHHIHRDIKSANILLDEAFTAKISDFGLARASEKFAQTVMTSRIVGTTAYMAPEALRGEITPKSDIYSFGVVLLEIITGLPAVDEHREPQLLLDIKEEIEDEEKTIEDYIDKKMNDADSTSVEAMYSVASQCLHEKKNKRPDIKKVQQLLQEMTAS

SEQ ID NO: 149 - protein, 120 aa, Homo sapiens
MWASELRGPGCADSLNAALAHSPLRNRQCRGFPGGGHSIQPLYTPRAPAAAPPPPHKMAAPIEETAAASPAPFCGRREICQHGKPLLRMHPSLETPLKGWSLGDHIKRKMPTTSTTSTRF

SEQ ID NO: 150 - protein, 527 aa, Homo sapiens
MSLCGARANAKMMAAYNGGTSAAAAGHHHHHHHHLPHLPPPHLHHHHHPQHHLHPGSAAAVHPVQQHTSSAAAAAAAAAAAAAMLNPGQQQPYFPSPAPGQAPGPAAAAPAQVQAAAAATVKAHHHQHSHHPQQQLDIEPDRPIGYGAFGVVWSVTDPRDGKRVALKKMPNVFQNLVSCKRVFRELKMLCFFKHDNVLSALDILQPPHIDYFEEIYVVTELMQSDLHKIIVSPQPLSSDHVKVFLYQILRGLKYLHSAGILHRDIKPGNLLVNSNCVLKICDFGLARVEELDESRHMTQEVVTQYYRAPEILMGSRHYSNAIDIWSVGCIFAELLGRRILFQAQSPIQQLDLITDLLGTPSLEAMRTACEGAKAHILRGPHKQPSLPVLYTLSSQATHEAVHLLCRMLVFDPSKRISAKDALAHPYLDEGRLRYHTCMCKCCFSTSTGRVYTSDFEPVTNPKFDDTFEKNLSSVRQVKEIIHQFILEQQKGNRVPLCINPQSAAFKSFISSTVAQPSEMPPSPLVWE

SEQ ID NO: 151 - protein, 248 aa, Homo sapiens
MRLIQNMCTIAEYPAPGNAAASDCCVGAAGRRLVKIAVVGASGVGKTALVVRFLTKRFIGDYERNAGNLYTRQVQIEGETLALQVQDTPGIQVHENSLSCSEQLNRCIRWADAVVIVFSITDYKSYELISQLHQHVQQLHLGTRLPVVVVANKADLLHIKQVDPQLGLQLASMLGCSFYEVSVSENYNDVYSAFHVLCKEVSHKQQPSSTPEKRRTSLIPRPKSPNMQDLKRRFKQALSAKVRTVTSV

SEQ ID NO: 152 - protein, 592 aa, Homo sapiens
MPSRTGPKMEGSGGRVRLKAHYGGDIFITSVDAATTFEELCEEVRDMCRLHQQHPLTLKWVDSEGDPCTVSSQMELEEAFRLARQCRDEGLIIHVFPSTPEQPGLPCPGEDKSIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 153 - protein, 673 aa, Homo sapiens; identical to SEQ ID NO: 94

SEQ ID NO: 154 - protein, 312 aa, Homo sapiens
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMDLIDSDELLDPEDLKKPDPASLRAASCGEGKKRKACKNCTCGLAEELEKEKSREQMSSQPKSACGNCYLGDAFRCASCPYLGMPAFKPGEKVLLSDSNLHDA

SEQ ID NO: 155 - protein, 546 aa, Homo sapiens
DRGSGAFSLETIAESSAQSPGCQLLVETLGVPLQEATELGDPTQADSARPEQSSQSPVQAVPGSGDSQPDDPPDRGTGLSASQRASQDHLSEQGADDSKPETDRVPGDGGQKEHLPSIDSEGEKPDRGAPQEGGAQRTAGAGLPRGPQEEGDGVPCTPASAPTSGPAPGLGPASWCLEPGSVAQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQRGIPDTTSELAGQRDHLPHSADQGTWADSLAVELDFLLDSQIQDALDASDFEAPPEQLFPSGNKPGPCWPGPSSHANGDPVAVAKAQPRTFVGIQASEASRMEDATNVVRGLIVELSNLNRLIMGTHRDLEAFKRLNYRKTKLGGKAPLPYPSKGPGNIPRGDPPWREL

What is claimed is:

1. A method for inducing an immune response in a human male to a prostate cancer-associated antigen, the method comprising administering to the human male an effective amount of a composition comprising:
   a) a PAK6 polypeptide comprising an amino acid sequence having at least 95% amino acid sequence identity to the amino acid sequence set forth in SEQ ID NO:9; and
   b) an adjuvant.

2. The method of claim 1, wherein the PAK6 polypeptide comprises an amino acid sequence that differs by at least one amino acid from the amino acid sequence set forth in SEQ ID NO:9.

3. The method of claim 1, wherein the PAK6 polypeptide has a length of from 5 amino acids to about 681 amino acids.

4. The method of claim 1, wherein the PAK6 polypeptide has a length of from 25 amino acids to about 100 amino acids.

5. The method of claim 1, wherein the PAK6 polypeptide is multimerized.

6. The method of claim 1, wherein the PAK6 polypeptide comprises an amino acid sequence having at least 98% amino acid sequence identity to the amino acid sequence set forth in SEQ ID NO:9.

7. The method of claim 1, wherein the adjuvant is alum, aluminum phosphate, aluminum hydroxide, or MF59.

8. The method of claim 1, wherein the PAK6 polypeptide is linked to a carrier.

9. The method of claim 8, wherein the carrier is tetanus toxoid or diphtheria toxoid.

10. The method of claim 1, wherein the immune response is an antibody response, a CD4$^+$ T cell response, or a cytotoxic T cell response.

11. The method of claim 1, wherein the polypeptide is administered in an amount of from about 100 µg to about 25 mg per dose.

12. The method of claim 1, wherein the polypeptide is administered in an amount of from about 100 µg to about 250 µg per dose.

13. The method of claim 1, wherein the human male has prostate cancer.

* * * * *